(12) United States Patent
Madison et al.

(10) Patent No.: US 8,519,103 B2
(45) Date of Patent: Aug. 27, 2013

(54) FACTOR VII POLYPEPTIDES THAT ARE MODIFIED AND USES THEREOF

(75) Inventors: Edwin L. Madison, San Francisco, CA (US); Christopher Thanos, San Francisco, CA (US)

(73) Assignee: Catalyst Biosciences, Inc., South San Francisco, CA (US)

( * ) Notice: Subject to any disclaimer, the term of this patent is extended or adjusted under 35 U.S.C. 154(b) by 713 days.

(21) Appl. No.: 12/384,915

(22) Filed: Apr. 10, 2009

(65) Prior Publication Data

US 2009/0291890 A1    Nov. 26, 2009

Related U.S. Application Data

(60) Provisional application No. 61/124,021, filed on Apr. 11, 2008.

(51) Int. Cl.
*A61K 38/36* (2006.01)
*C07K 14/745* (2006.01)
*A61P 7/04* (2006.01)

(52) U.S. Cl.
USPC .................. 530/384; 514/13.5; 514/14.3

(58) Field of Classification Search
None
See application file for complete search history.

(56) References Cited

U.S. PATENT DOCUMENTS

| | | | |
|---|---|---|---|
| 4,522,811 A | 6/1985 | Eppstein et al. | 514/2 |
| 4,784,950 A | 11/1988 | Hagen et al. | 435/69.6 |
| 4,892,538 A | 1/1990 | Aebischer et al. | 604/891.1 |
| 4,952,496 A | 8/1990 | Studier et al. | 435/91.41 |
| 5,033,252 A | 7/1991 | Carter | 53/425 |
| 5,052,558 A | 10/1991 | Carter | 206/439 |
| 5,283,187 A | 2/1994 | Aebischer et al. | 435/182 |
| 5,323,907 A | 6/1994 | Kalvelage | 206/531 |
| 5,580,560 A | 12/1996 | Nicolaisen et al. | 424/94.64 |
| 5,788,965 A | 8/1998 | Berkner et al. | 424/94.64 |
| 5,817,788 A | 10/1998 | Berkner et al. | 536/23.2 |
| 5,824,639 A | 10/1998 | Berkner | 514/14.3 |
| 5,861,374 A | 1/1999 | Berkner et al. | 514/8 |
| 6,017,882 A | 1/2000 | Nelsestuen | 514/12 |
| 6,183,743 B1 * | 2/2001 | Hart et al. | 424/94.64 |
| 6,677,440 B1 | 1/2004 | Roemisch et al. | 530/412 |
| 6,693,075 B1 | 2/2004 | Nelsestuen | 514/12 |
| 6,762,286 B2 | 7/2004 | Nelsestuen | 530/380 |
| 6,806,063 B2 | 10/2004 | Pedersen et al. | 435/69.1 |
| 6,903,069 B2 | 6/2005 | Pingel et al. | 514/2 |
| 6,905,683 B2 | 6/2005 | Persson et al. | 424/94.63 |
| 6,911,323 B2 | 6/2005 | Persson et al. | 435/69.1 |
| 6,960,657 B2 | 11/2005 | Persson et al. | 536/23.1 |
| 7,026,524 B2 | 4/2006 | Persson et al. | 800/8 |
| 7,052,868 B2 | 5/2006 | Persson et al. | 435/69.1 |
| 7,173,000 B2 | 2/2007 | Ruf et al. | 514/2 |
| 7,176,288 B2 | 2/2007 | Persson et al. | 530/381 |
| 7,235,638 B2 | 6/2007 | Persson | 530/381 |
| 7,247,708 B2 | 7/2007 | Nelsestuen | 530/384 |
| 7,291,587 B2 | 11/2007 | Rojkjaer | 514/2 |
| 7,416,861 B2 | 8/2008 | Persson et al. | 435/69.1 |
| 7,419,949 B2 | 9/2008 | Hedner | 514/2 |
| 7,427,592 B2 | 9/2008 | Pedersen et al. | 514/2 |
| 7,432,352 B2 | 10/2008 | Johansen | 530/350 |
| 7,442,524 B2 | 10/2008 | Pedersen et al. | 435/69.6 |
| 8,211,428 B2 | 7/2012 | Madison | 424/94.64 |
| 2002/0166130 A1 | 11/2002 | Velander et al. | 800/7 |
| 2003/0044908 A1 | 3/2003 | Persson | 435/69.1 |
| 2003/0069395 A1 | 4/2003 | Sato et al. | 530/350 |
| 2003/0096338 A1 | 5/2003 | Pedersen et al. | 435/69.1 |
| 2003/0100075 A1 | 5/2003 | Persson et al. | 435/69.6 |
| 2003/0100506 A1 | 5/2003 | Nelsestuen | 514/12 |
| 2003/0100740 A1 | 5/2003 | Persson et al. | 530/381 |
| 2003/0104978 A1 | 6/2003 | Persson et al. | 514/2 |
| 2003/0119168 A1 | 6/2003 | Madison et al. | 435/226 |
| 2003/0130191 A1 | 7/2003 | Persson et al. | 514/12 |
| 2003/0134298 A1 | 7/2003 | Madison et al. | 435/6 |
| 2003/0134794 A1 | 7/2003 | Madison et al. | 514/12 |
| 2003/0143219 A1 | 7/2003 | Madison et al. | 424/94.67 |
| 2004/0001801 A1 | 1/2004 | Madison et al. | 424/85.1 |
| 2004/0009534 A1 | 1/2004 | Sato et al. | 435/7.1 |
| 2004/0087498 A1 | 5/2004 | Berkner et al. | 514/12 |
| 2004/0133930 A1 | 7/2004 | Cooper et al. | 800/7 |
| 2004/0146938 A1 | 7/2004 | Nguyen et al. | 435/7.1 |
| 2004/0192602 A1 | 9/2004 | Persson et al. | 514/12 |
| 2004/0220106 A1 | 11/2004 | Nelsestuen | 514/12 |
| 2005/0032690 A1 | 2/2005 | Rojkjaer et al. | 514/12 |
| 2005/0112579 A1 | 5/2005 | Madison et al. | 435/6 |
| 2005/0164932 A1 | 7/2005 | Haaning et al. | 514/12 |
| 2005/0204406 A1 | 9/2005 | Persson et al. | 800/7 |
| 2005/0204411 A1 | 9/2005 | Persson et al. | 800/8 |

(Continued)

FOREIGN PATENT DOCUMENTS

| | | |
|---|---|---|
| EP | 1 361 284 | 11/2003 |
| EP | 1 726 643 | 11/2006 |
| EP | 1 504 117 | 7/2007 |
| EP | 2 316 930 | 4/2011 |
| EP | 1 633 865 | 9/2011 |
| WO | WO 88/10295 | 12/1988 |
| WO | WO 92/06203 | 4/1992 |
| WO | WO 01/32711 | 5/2001 |
| WO | WO 01/58935 | 8/2001 |
| WO | WO 01/83725 | 11/2001 |

(Continued)

OTHER PUBLICATIONS

Soriano-Garcia, M., et al. 1989 Biochemistry 28: 6805-6810.*

(Continued)

*Primary Examiner* — Marsha Tsay

(74) *Attorney, Agent, or Firm* — McKenna Long & Aldridge LLP; Stephanie Seidman

(57) ABSTRACT

Modified factor VII polypeptides and uses thereof are provided. Such modified FVII polypeptides include Factor VIIa and other forms of Factor VII. Among modified FVII polypeptides provided are those that have altered activities, typically altered procoagulant activity, including increased procoagulant activities. Hence, such modified polypeptides are therapeutics.

71 Claims, 3 Drawing Sheets

(56) References Cited

U.S. PATENT DOCUMENTS

| | | | |
|---|---|---|---|
| 2006/0002916 A1 | 1/2006 | Ruggles et al. | 424/94.63 |
| 2006/0019336 A1 | 1/2006 | Pederson et al. | 435/69.1 |
| 2006/0019893 A1 | 1/2006 | Maun et al. | 514/12 |
| 2006/0024289 A1 | 2/2006 | Ruggles et al. | 424/94.64 |
| 2006/0029590 A1 | 2/2006 | Thanos et al. | 424/94.63 |
| 2006/0111282 A1 | 5/2006 | Haaning et al. | 514/12 |
| 2006/0116324 A1 | 6/2006 | Persson et al. | 514/12 |
| 2006/0166874 A1 | 7/2006 | Haaning et al. | 514/12 |
| 2006/0166915 A1 | 7/2006 | Persson et al. | 514/44 |
| 2006/0205036 A1 | 9/2006 | Ostergaard et al. | 435/69.6 |
| 2006/0228782 A1 | 10/2006 | Pedersen et al. | 435/69.6 |
| 2006/0240524 A1 | 10/2006 | Pedersen et al. | 435/69.6 |
| 2006/0240525 A1 | 10/2006 | Pedersen et al. | 435/69.6 |
| 2006/0240526 A1 | 10/2006 | Haaning et al. | 435/69.6 |
| 2006/0241041 A1 | 10/2006 | Haaning et al. | 514/12 |
| 2006/0252127 A1 | 11/2006 | Pedersen et al. | 435/69.6 |
| 2006/0252128 A1 | 11/2006 | Haaning et al. | 435/69.6 |
| 2006/0252129 A1 | 11/2006 | Persson et al. | 435/69.6 |
| 2006/0252689 A1 | 11/2006 | Pedersen et al. | 514/12 |
| 2006/0252690 A1 | 11/2006 | Pedersen et al. | 514/12 |
| 2006/0258585 A1 | 11/2006 | Pedersen et al. | 514/12 |
| 2006/0264373 A1 | 11/2006 | Nelsestuen | 514/12 |
| 2006/0270000 A1 | 11/2006 | Haaning et al. | 435/69.6 |
| 2006/0270001 A1 | 11/2006 | Haaning et al. | 435/69.6 |
| 2006/0270002 A1 | 11/2006 | Haaning et al. | 435/69.6 |
| 2006/0276377 A1 | 12/2006 | Haaning et al. | 514/8 |
| 2007/0037746 A1 | 2/2007 | Ostergaard et al. | 514/12 |
| 2007/0054366 A1 | 3/2007 | Andersen et al. | 435/69.6 |
| 2007/0093443 A1 | 4/2007 | Madison et al. | 514/44 |
| 2007/0117756 A1 | 5/2007 | Haaning et al. | 514/12 |
| 2007/0142280 A1 | 6/2007 | Pedersen et al. | 514/12 |
| 2007/0202045 A1 | 8/2007 | Dennis | 424/9.1 |
| 2007/0243588 A1 | 10/2007 | Pedersen et al. | 435/69.6 |
| 2007/0280920 A1 | 12/2007 | Petersen et al. | 424/94.5 |
| 2008/0004216 A1 | 1/2008 | Nelsestuen | 514/12 |
| 2008/0010693 A1 | 1/2008 | Persson et al. | 800/7 |
| 2008/0026994 A1 | 1/2008 | Nelsestuen | 514/12 |
| 2008/0058255 A1 | 3/2008 | Bolt et al. | 514/12 |
| 2008/0102115 A1 | 5/2008 | Oyhenart et al. | 424/457 |
| 2008/0188400 A1 | 8/2008 | Ropke et al. | 514/2 |
| 2009/0047210 A1 | 2/2009 | Ruggles et al. | 424/1.11 |
| 2009/0055942 A1 | 2/2009 | Ostergaard et al. | 800/13 |
| 2009/0098103 A1 | 4/2009 | Madison et al. | 424/94.64 |
| 2009/0123452 A1 | 5/2009 | Madison | 424/94.64 |
| 2009/0136477 A1 | 5/2009 | Nguyen et al. | 424/94.64 |
| 2010/0166729 A9 | 7/2010 | Madison et al. | 424/94.64 |
| 2010/0330059 A1 | 12/2010 | Stafford et al. | 424/94.3 |

FOREIGN PATENT DOCUMENTS

| | | |
|---|---|---|
| WO | WO 02/20475 | 3/2002 |
| WO | WO 02/22776 | 3/2002 |
| WO | WO 02/38162 | 5/2002 |
| WO | WO 02/072786 | 9/2002 |
| WO | WO 02/077218 | 10/2002 |
| WO | WO 02/077263 | 10/2002 |
| WO | WO 02/077267 | 10/2002 |
| WO | WO 02/092841 | 11/2002 |
| WO | WO 02/095007 | 11/2002 |
| WO | WO 03/004681 | 1/2003 |
| WO | WO 03/027147 | 4/2003 |
| WO | WO 03/029442 | 4/2003 |
| WO | WO 03/031585 | 4/2003 |
| WO | WO 03/044179 | 5/2003 |
| WO | WO 03/037932 | 7/2003 |
| WO | WO 03/055511 | 7/2003 |
| WO | WO 03/093465 | 11/2003 |
| WO | WO 03/095670 | 11/2003 |
| WO | WO 03/104394 | 12/2003 |
| WO | WO 04/000366 | 12/2003 |
| WO | WO 2004/005471 | 1/2004 |
| WO | WO 2004/029090 | 4/2004 |
| WO | WO 2004/029091 | 4/2004 |
| WO | WO 2004/056384 | 7/2004 |
| WO | WO 2004/083361 | 9/2004 |
| WO | WO 2004/083421 | 9/2004 |
| WO | WO 2004/108763 | 12/2004 |
| WO | WO 2004/110469 | 12/2004 |
| WO | WO 2004/111242 | 12/2004 |
| WO | WO 2004/113521 | 12/2004 |
| WO | WO 2004/113522 | 12/2004 |
| WO | WO 2005/023308 | 3/2005 |
| WO | WO 2005/024006 | 3/2005 |
| WO | WO 2005/032581 | 4/2005 |
| WO | WO 2005/068620 | 7/2005 |
| WO | WO 2005/075635 | 8/2005 |
| WO | WO 2005/111225 | 11/2005 |
| WO | WO 2005/123119 | 12/2005 |
| WO | WO 2005/123916 | 12/2005 |
| WO | WO 2006/008267 | 1/2006 |
| WO | WO 2006/013202 | 2/2006 |
| WO | WO 2006/014253 | 2/2006 |
| WO | WO 2006/018204 | 2/2006 |
| WO | WO 2006/067198 | 6/2006 |
| WO | WO 2006/067230 | 6/2006 |
| WO | WO 2006/114105 | 11/2006 |
| WO | WO 2006/125827 | 11/2006 |
| WO | WO 2006/134174 | 12/2006 |
| WO | WO 2007/022512 | 2/2007 |
| WO | WO 2007/026020 | 3/2007 |
| WO | WO 2007/031559 | 3/2007 |
| WO | WO 2007/039475 | 4/2007 |
| WO | WO 2007/044874 | 4/2007 |
| WO | WO 2007/149406 | 12/2007 |
| WO | WO 2008/009634 | 1/2008 |
| WO | WO 2008/009635 | 1/2008 |
| WO | WO 2008/078189 | 7/2008 |
| WO | WO 2008/090215 | 7/2008 |
| WO | WO 2008/127702 | 10/2008 |
| WO | WO 2009/126307 | 10/2009 |

OTHER PUBLICATIONS

Sergel, T.A., et al. 2000 Journal of Virology 74(11): 5101-5107.*

Yuan, S-M., et al. 1998 Proteins 30: 136-143.*

Lee, et al. 1995 The EMBO Journal 14(20): 5006-5015.*

Becker et al., "Endothelial function and hemostasis," Z. Kardiologie 89:160-167 (2000).

Hemker et al., "Platelet membrane involvement in blood coagulation," Blood Cells 9:303-317 (1983).

Hoffman et al., "A cell-based model of hemostasis," Thromb Haemost 85:958-965 (2001).

King, M., "Blood coagulation," found at: med.unibs.it/~marchesi/blood.html (2006) [accessed on Apr. 27, 2009] [14 pages].

Ruggeri, "Platelets in atherothrombosis," Nat Med 8:1227-1234 (2002).

Savage et al., "Mechanisms of platelet aggregation," Curr Opin Hematol 8:270-276 (2001).

Yang et al., "Genome-wide association and linkage analyses of hemostatic factors and hematological phenotypes in the Framingham Heart Study," BMC Med Genet. 8 Suppl 1:S12 (2007).

Krishnaswamy et al., "Regulation of extrinsic pathway factor Xa formation by tissue factor pathway inhibitor," J Biol Chem. 273(8):4378-4386 (1998).

Olson et al., "Accelerating ability of synthetic oligosaccharides on antithrombin inhibition of proteinases of the clotting and fibrinolytic systems. Comparison with heparin and low-molecular-weight heparin," Thromb Haemost 92(5):929-939 (2004).

Pedersen et al., "Recombinant human extrinsic pathway inhibitor. Production, isolation, and characterization of its inhibitory activity on tissue factor-initiated coagulation reactions," J Biol. Chem. 265:16786-16793 (1990).

Persson, E., "Protein disulfide isomerase has no stimulatory chaperone effect on factor X activation by factor VIIa-soluble tissue factor," Thromb Res. 123(1):171-176 (2008).

Smith et al., "Protein loop grafting to construct a variant of tissue-type plasminogen activator that binds platelet integrin alpha IIb beta 3," J. Biol. Chem. 270:30486-30490 (1995).

Banner et al., "The crystal structure of the complex of blood coagulation factor VIIa with soluble tissue factor," Nature 380:41-46 (1996).

Bernardi et al., "Molecular defects in CRM+ factor VII deficiencies: modelling of missense mutations in the catalytic domain of FVII," Br. J. Haematol. 86:610-618 (1994).

Bernardi et al., "Mutation pattern in clinically asymptomatic coagulation factor VII deficiency," Human Mut. 8:108-115 (1996).

Broze et al., "Purification and properties of human coagulation factor VII," J Biol Chem 255:1242-1247 (1980).

Butenas et al., "Kinetics of human factor VII activation," Biochemistry 35:1904-1910 (1996).

Herrmann et al, "International Greifswald Registry of FVII deficiency. Variability of clinical manifestation of factor VII-deficiency in homozygous and heterozygous subjects of the European F7 gene mutation A294V," Haematologica. 93(8):1273-1275 (2008).

Higashi et al., "Molecular mechanism of tissue factor-mediated acceleration of factor VIIa activity," J Biol Chem 271:26569-26574 (1996).

Himmelspach et al., "Recombinant human factor X: high yield expression and the role of furin in proteolytic maturation in vivo and in vitro," Thromb Research 97; 51-67 (2000).

Hoffman et al., "Activated factor VII activates factors IX and X on the surface of activated platelets: thoughts on the mechanism of action of high-dose activated factor VII," Blood Coagul Fibrinolysis 9:S61-S65 (1998).

Jin et al., "Four loops of the catalytic domain of factor viia mediate the effect of the first EGF-like domain substitution on factor viia catalytic activity," J Mol Biol, 307: 1503-1517 (2001).

Maguire et al., "Polymorphisms in platelet glycoprotein 1b alpha and factor VII and risk of ischemic stroke:a meta-analysis," Stroke. 39(6):1710-1716 (2008).

Monroe et al., "Platelet activity of high-dose factor VIIa is independent of tissue factor," Br J Haematol 99:542-547 (1997).

Nakagaki et al., "Initiation of the extrinsic pathway of blood coagulation: evidence for the tissue factor dependent autoactivation of human coagulation factor VII," Biochemistry. 30(45):10819-10824 (1991).

Osterlund et al., "Spectroscopic probing of the influence of calcium and the gla domain on the interaction between the first EGF domain in factor VIIa and tissue factor," Eur J Biochem 267:6204-6211 (2000).

Pike et al., "Structure of human factor VIIa and its implications for the triggering of blood coagulation," Proc. Nat. Acad. Sci. USA. 8925-8930 (1999).

Ratko et al., "Off-label use of recombinant activated factor VII (NovoSeven)," P & T 29:712-720 (2004).

Wildgoose et al., "Measurement of basal levels of factor VIIa in hemophilia A and B patients," Blood 80:25-28 (1992).

Bajaj et al., "High resolution structures of p-aminobenzamidine- and benzamidine-VIIa/soluble tissue factor: unpredicted conformation of the 192-193 peptide bond and mapping of Ca2+, Mg2+, Na+, and Zn2+ sites in factor VIIa," J. Biol. Chem. 281:24873-24888 (2006).

Bernardi et al. "Comparison among natural (Arg304Gln, Arg304Trp) and artificial (Arg290His, Arg290Lys) mutation sin coagulation factor VII loops," J Thromb Haemost. 1(11):2455-2457 (2003).

Bjelke et al., "A loop of coagulation factor VIIa influencing macromolecular substrate specificity," FEBS Lett. 581(1):71-76 (2007).

Bjelke et al., "Mechanism of the Ca2+-induced enhancement of the intrinsic factor VIIa activity," J Biol Chem. 283(38):25863-25870 (2008).

Bjoern et al., "Human plasma and recombinant Factor VII," J Biol Chem. 2166:11051-11057 (1991).

Brophy et al., "Effect of recombinant factor VIIa variant (NN1731) on platelet function, clot structure and force onset time in whole blood from healthy volunteers and haemophilia patients," Haemophilia 13(5):533-541 (2007).

Catalyst press release May 6, 2008. http://www.catalystbiosciences.com/news-pr-factorVII.html (2 pages).

Chang et al., "Engineered recombinant factor VII Q217 variants with altered inhibitor specificities," Biochemistry 38:10940-10948 (1999).

Clarke, B. and M. Blajchman, "Human FVII(K62E) does not exhibit enhanced binding to tissue factor," J Thromb Haemost. 6(7):1229 (2008).

Dickinson et al., "Identification of surface residues mediating tissue factor binding and catalytic function of the serine protease factor VIIa," Proc. Nat. Acad. Sci. USA. 93:14379-14384 (1996).

Geng et al., "Properties of a recombinant chimeric protein in which the gamma-carboxyglutamic acid and helical stack domains of human anticoagulant protein C are replaced by those of human coagulation factor VII," Thromb Haemost 77:926-933 (1997).

Ghosh et al., transcript of presentation at the Am. Society. Hematol. Meeting, Dec. 10, 2007.

Harvey et al., "Mutagenesis of the gamma-carboxyglutamic acid domain of human factor VII to generate maximum enhancement of the membrane contact site," 278:8363-8369 (2003).

Iakhiaev et al., "The role of catalytic cleft and exosite residues of factor VIIa for complex formation with tissue factor pathway inhibitor," Thromb. Haemost. 85:458-463. (2001).

Larsen et al., "Engineering the substrate and inhibitor specificities of human coagulation Factor VIIa," Biochem J. 405(3):429-438 (2007).

Lee et al., "Compound heterozygous mutations in severe factor VII deficiency including a novel nonsense mutation," Blood Coagul Fibrinolysis. 19(1):92-94 (2008).

Liebman et al., "Immunoaffinity purification of factor IX (Christmas factor) by using conformation-specific antibodies directed against the factor IX-metal complex," Proc. Nat. Acad. Sci. USA., 82:3879-3883 (1985).

Lin et al., "Binding of the factor IX gamma-carboxyglutamic acid domain to the vitamin K-dependent gamma-glutamyl carboxylase active site induces an allosteric effect that may ensure processive carboxylation and regulate the release of carboxylated product," J Biol Chem 279:6560-6566 (2004).

Maun et al., "Disulfide locked variants of factor VIIa with a restricted beta-strand conformation have enhanced enzymatic activity," Prot Sci 14:1171-1180 (2005).

Nelsestuen et al., "Elevated function of blood clotting factor VIIa mutants that have enhanced affinity for membranes. Behavior in a diffusion-limited reaction," J Biol Chem. 276(43):39825-39831 (2001).

Neuenschwander, P. and J. Morrissey, "Alteration of the substrate and inhibitor specificities of blood coagulation factor VIIa: importance of amino acid residue K192," Biochemistry. 34(27):8701-8707 (1995).

Persson E. "Variants of recombinant factor VIIa with increased Intrinsic Activity," Semin Hematol. 41(1 Suppl 1):89-92 (2004).

Persson et al., "Assignment of molecular properties of a superactive coagulation factor VIIa variant to individual amino acid changes," Eur J Biochem 269:5950-5955 (2002).

Persson et al., "Augmented intrinsic activity of Factor VIIa by replacement of residues 305, 314, 337 and 374: evidence of two unique mutational mechanisms of activity enhancement," Biochem J., 379: 497-503 (2004).

Persson et al., "Rational design of coagulation factor VIIa variants with substantially increased intrinsic activity," Proc. Nat. Acad. Sci. USA. 98:13583-13588 (2001).

Persson et al., "A variant of recombinant factor VIIa with enhanced procoagulant and antifibrinolytic activities in an in vitro model of hemophilia," Art. Thromb. Vasc. Biol. 27(3):683-689 (2007).

Petersen et al., "Binding of Zn2+ to a Ca2+ loop allosterically attenuates the activity of factor VIIa and reduces its affinity for tissue factor," Protein Science 9:859-866 (2000).

Petrovan, R. and W. Ruf, "Residue Met(156) contributes to the labile enzyme conformation of coagulation factor VIIa," J Biol Chem. 276(9):6616-6620 (2001).

Przysiecki et al., "Occurrence of beta-hydroxylated asparagine residues in non-vitamin K-dependent proteins containing epidermal growth factor-like domains," PNAS 84:7856-7860 (1987).

Pusateri et al., "Mechanistic implications for the use and monitoring of recombinant activated factor VII in trauma," Critical Care 9:S15-S24 (2005).

Rand et al., "The origins of enhanced activity in factor VIIa analogs and the interplay between key allosteric sites revealed by hydrogen exchange mass spectrometry," J Biol Chem. 283(19):13378-13387 (2008).

Rao et al., "Binding of factor VIIa to tissue factor permits rapid antithrombin III/heparin inhibition of factor VIIa," Blood 81:2600-2607 (1993).

Ruf, W. "Factor VIIa residue Arg290 is required for efficient activation of the macromolecular substrate factor X" Biochemistry 33:11631-11636 (1994).

Ruf et al., "Importance of factor VIIa Gla-domain residue Arg-36 for recognition of the macromolecular substrate factor X Gla-domain," Biochemistry 38:1957-1966 (1999).

Shah et al., "Manipulation of the membrane binding site of vitamin K-dependent proteins: enhanced biological function of human factor VII," Proc. Nat. Acad. Sci. USA. 95:4229-4234 (1998).

Soejima et al., "Factor VIIa modified in the 170 loop shows enhanced catalytic activity but does not change the zymogen-like property," J Biol Chem 276:17229-17235 (2001).

Soejima et al., "The 99 and 170 loop-modified factor VIIa mutants show enhanced catalytic activity without tissue factor," J Biol Chem 277:49027-49035 (2002).

Sun et al., "Gla domain-mutated human protein C exhibiting enhanced anticoagulant activity and increased phospholipid binding," Blood 101:2277-2284 (2003).

Williamson et al., "Interspecies exchange mutagenesis of the first epidermal growth factor-like domain of human factor VII," J Thromb Haemost 3:1250-1256 (2005).

Zhidong et al., "Severe factor VII deficiency caused by a novel point mutation (Arg353Pro) combined with a rare Cys22Arg mutation," Thromb Haemost. 98(3):687-688 (2007).

Jurlander et al., "Recombinant activated factor VII (rFVIIa): characterization, manufacturing, and clinical development," Semin Thromb Hemost 27:373-384 (2001).

Kemball-Cook et al., "Coagulation factor VII Gln100—> Arg. Amino acid substitution at the epidermal growth factor 2-protease domain interface results in severely reduced tissue factor binding and procoagulant function," J Biol Chem 273:8516-8521 (1998).

Wajih et al., "Increased production of functional recombinant human clotting factor IX by baby hamster kidney cells engineered to overexpress VKORC1, the vitamin K 2,3-epoxide-reducing enzyme of the vitamin K cycle," J. Biol. Chem. 280(36)31603-31607 (2005).

Brinkhous et al., "Effect of recombinant factor VIIa on the hemostatic defect in dogs with hemophilia A, hemophilia B, and von Willebrand disease," PNAS 86:1382-1386 (1989).

Chan et al., "Assessment of recombinant factor VIIa as an antidote for bleeding induced in the rabbit by low molecular weight heparin," J Thromb Haemost 1:760-765 (2003).

Diness et al., "Recombinant human factor VIIa (rFVIIa) in a rabbit stasis model," Thromb Res 67:233-241 (1992).

Elg et al., "Effect of activated prothrombin complex concentrate or recombinant factor VIIa on the bleeding time and thrombus formation during anticoagulation with a direct thrombin inhibitor," Thromb Res 101:145-157 (2001).

Fattorutto et al., "Recombinant activated factor VII decreases bleeding without increasing arterial thrombosis in rabbits," Can J Anaesth 51:672-679 (2004).

Lynn et al., "Early use of recombinant factor VIIa improves mean arterial pressure and may potentially decrease mortality in experimental hemorrhagic shock: a pilot study," J Trauma 52:703-707 (2002).

Martinowitz et al., "Intravenous rFVIIa administered for hemorrhage control in hypothermic coagulopathic swine with grade V liver injuries," J Trauma 50:721-729 (2001).

Sondeen et al., "Recombinant factor VIIa increases the pressure at which rebleeding occurs in porcine uncontrolled aortic hemorrhage model," Shock 22:163-168 (2004).

Tranholm et al., "Improved hemostasis with superactive analogs of factor VIIa in a mouse model of hemophilia A," Blood 102:3615-3620 (2003).

Tranholm et al., "Recombinant factor VIIa reduces bleeding in severely thrombocytopenic rabbits," Thromb Res 109:217-223 (2003).

Al Douri et al., "Effect of the administration of recombinant activated factor VII (rFVIIa; NovoSeven) in the management of severe uncontrolled bleeding in patients undergoing heart valve replacement surgery," Blood Coag Fibrinol 11:S121-S127 (2000).

Boggio et al., "Recombinant human factor VIIa in the management of amyloid-associated factor X deficiency," Br J Haematol 112:1074-1075 (2001).

Deveras et al., "Reversal of warfarin-induced excessive anticoagulation with recombinant human factor VIIa concentrate," Ann Inten Med 137:884-888 (2002).

Friederich et al., "Effect of recombinant activated factor VII on perioperative blood loss in patients undergoing retropubic prostatectomy: a double-blind placebo-controlled randomised trial," Lancet 361:201-205 (2003).

Gerlach et al., "Application of recombinant activated factor VII during surgery for a giant skull base hemangiopericytoma to achieve safe hemostasis. Case report," J Neurosurg 96:946-948 (2002).

Gerotziafas et al., "Effective hemostasis with rFVIIa treatment in two patients with severe thrombocytopenia and life-threatening hemorrhage," Am J Hematol 69:219-222 (2002).

Hicks et al., "Treatment of diffuse alveolar hemorrhage after allogeneic bone marrow transplant with recombinant factor VIIa," Bone Marrow Transpl 30:975-978 (2002).

Kastrup et al., "Recombinant factor VIIa after aortic valve replacement in a patient with osteogenesis imperfecta," Ann Thorac Surg 74:910-912 (2002).

Kenet et al., "Treatment of traumatic bleeding with recombinant factor VIIa," Lancet 354:1879 (1999).

Moscardo et al., "Successful treatment of severe intra-abdominal bleeding associated with disseminated intravascular coagulation using recombinant activated factor VII," Br J Haematol 113:174-176 (2001).

Olomu et al., "Treatment of severe pulmonary hemorrhage with activated recombinant factor VII (rFVIIa) in very low birth weight infants," J Perinatol. 22(8):672-674 (2002).

Rizoli et al., "Recombinant activated factor VII as an adjunctive therapy for bleeding control in severe trauma patients with coagulopathy: subgroup analysis from two randomized trials," Crit Care 10:R178 (2006).

Sajdak et al., "Bleeding from endometrial and vaginal malignant tumors treated with activated recombinant factor VII," Eur J Gynaecol Oncol 23:325-326 (2002).

Shami et al. Recombinant activated factor VII for coagulopathy in fulminant hepatic failure compared with conventional therapy. Liver Transpl 9:138-143 (2003).

Sommer et al., "Immunogenicity of novel recombinant human activated factor VII analogues on factor VII neonatally-tolerized rats," Thromb Haemost. 98(4):721-725 (2007).

van Buuren et al., "Successful surgery using recombinant factor VIIa for recurrent, idiopathic nonulcer duodenal bleeding in a patient with Glanzmann's thrombasthenia," Dig Dis Sci 47:2134-2136 (2002).

Vlot et al., "Treatment of a severely bleeding patient without preexisting coagulopathy with activated recombinant factor VII," Am J Med 108:421-423 (2000).

von Depka et al., "The use of recombinant-activated factor VII in von Willebrand disease: a case series," Blood Coagul Fibrin 17:311-316 (2006).

Bi et al., "Targeted disruption of the mouse factor VIII gene produces a model of haemophilia A," Nat Gen 10:119-121 (1995).

Margaritis et al., "Novel therapeutic approach for hemophilia using gene delivery of an engineered secreted activated Factor VII," J Clin Invest 113:1025-1031 (2004).

Srour et al., "Regulation of human factor IX expression using doxycycline-inducible gene expression system," Thromb Haemost. 90(3): 398-405 (2003).

Adams et al., "The c-myc oncogene driven by immunoglobulin enhancers induces lymphoid malignancy in transgenic mice," Nature 318:533-538 (1985).

Alexander et al., "Expression of the c-myc oncogene under control of an immunoglobulin enhancer in E mu-myc transgenic mice," Mol. Cell Biol. 7:1436-1444 (1987).

Bernoist, C. and P. Chambon, "In vivo sequence requirements of the SV40 early promoter region," Nature 290:304-310 (1981).

Brinster et al., "Regulation of metallothionein—thymidine kinase fusion plasmids injected into mouse eggs," Nature 296:39-42 (1982).

Bock et al., "Isolation of human blood coagulation alpha-factor Xa by soybean trypsin inhibitor-sepharose chromatography and its active-site titration with fluorescein mono-p-guanidinobenzoate," Archives of Biochemistry and Biophysics 273:375-388 (1989).

DeBoer et al., "The tac promoter: a functional hybrid derived from the trp and lac promoters," Proc. Natl. Acad. Sci. USA 80:21-25 (1983).

Gardner et al., "The complete nucleotide sequence of an infectious clone of cauliflower mosaic virus by M13mp7 shotgun sequencing," Nucleic Acids Res. 9:2871 (1981).

Gilbert et al., "Useful Proteins from Recombinant Bacteria," Scientific American 242:79-94 (1980).

Grosschedl et al., "Introduction of a mu immunoglobulin gene into the mouse germ line: specific expression in lymphoid cells and synthesis of functional antibody," Cell 38:647-658 (1984).

Hammer et al., "Diversity of alpha-fetoprotein gene expression in mice is generated by a combination of separate enhancer elements," Science 235:53-58 (1987).

Hanahan et al., "Heritable formation of pancreatic beta-cell tumours in transgenic mice expressing recombinant insulin/simian virus 40 oncogenes," Nature 315:115-122 (1985).

Herrara-Estrella et al., "Expression of chimaeric genes transferred into plant cells using a Ti-plasmid-derived vector," Nature 303:209-213 (1983).

Herrera-Estrella et al., "Light-inducible and chloroplast-associated expression of a chimaeric gene introduced into *Nicotiana tabacum* using a Ti plasmid vector," Nature 310:115-120 (1984).

Jay et al., "Construction of a general vector for efficient expression of mammalian proteins in bacteria: use of a synthetic ribosome binding site," Proc. Natl. Acad. Sci. USA 78:5543-5548 (1981).

Kelsey et al., "Species- and tissue-specific expression of human alpha 1-antitrypsin in transgenic mice," Genes and Devel. 1:161-171 (1987).

Ketner et al., "Efficient manipulation of the human adenovirus genome as an infectious yeast artificial chromosome clone," PNAS 91:6186-6190 (1994).

Khalilzadeh et al., "Process development for production of recombinant human interferon-gamma expressed in *Escherichia coli*," J. Ind. Microbiol. Biotechnol. 31(2): 63-69 (2004).

Kollias et al., "Regulated expression of human A gamma-, beta-, and hybrid gamma beta-globin genes in transgenic mice: manipulation of the developmental expression patterns," Cell 46:89-94 (1986).

Krumlauf et al., "Developmental regulation of alpha-fetoprotein genes in transgenic mice," Mol. Cell. Biol. 5:1639-1648 (1985).

Leder et al., "Consequences of widespread deregulation of the c-myc gene in transgenic mice: multiple neoplasms and normal development," Cell 45:485-495 (1986).

Lindenbaum et al., "A mammalian artificial chromosome engineering system (ACE System) applicable to biopharmaceutical protein production, transgenesis and gene-based cell therapy," Nucleic Acids Res. 32(21):e172 (2004).

MacDonald, R., "Release of leukotrienes during rapid expulsion of *Trichinella spiralis* from immune rats," Hepatology 7:425-515 (1987).

Magram et al., "Developmental regulation of a cloned adult beta-globin gene in transgenic mice," Nature 315:338-340 (1985).

Mason et al., "The hypogonadal mouse: reproductive functions restored by gene therapy," Science 234:1372-1378 (1986).

Mayfield et al., "Expression and assembly of a fully active antibody in algae," Proc. Nat. Acad. Sci. USA., 100:438-442 (2003).

Muneta et al., "Large-scale production of porcine mature interleukin-18 (IL-18) in silkworms using a hybrid baculovirus expression system," J Vet Med Sci. 65(2):219-223 (2003).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Pham et al., "Large-scale transient transfection of serum-free suspension-growing HEK293 EBNA1 cells: peptone additives improve cell growth and transfection efficiency," Biotechnol. Bioeng. 84:332-342 (2003).

Pinkert et al., "An albumin enhancer located 10 kb upstream functions along with its promoter to direct efficient liver-specific expression in transgenic mice," Genes and Devel. 1:268-276 (1987).

Platis et al., "High yield expression, refolding, and characterization of recombinant interferon alpha2/alpha8 hybrids in *Escherichia coli*," Protein Exp. Purif. 31(2): 222-230 (2003).

Readhead et al., "Expression of a myelin basic protein gene in transgenic shiverer mice: correction of the dysmyelinating phenotype," Cell 48:703-712 (1987).

Shani, "Tissue-specific expression of rat myosin light-chain 2 gene in transgenic mice," Nature 314:283-286 (1985).

Skoko et al., "Expression and characterization of human interferon-beta 1 in the methylotrophic yeast *Pichia pastoris*," Biotechnol. Appl. Biochem. 38(Pt3):257-265 (2003).

Swift et al., "Tissue-specific expression of the rat pancreatic elastase I gene in transgenic mice," Cell 38:639-646 (1984).

Wagner et al., "Nucleotide sequence of the thymide kinase gene of herpes simplex virus type 1," Proc. Natl. Acad. Sci. USA 78:1441-1445 (1981).

Yamamoto et al., "Identification of a functional promoter in the long terminal repeat of *Rous sarcoma* virus," Cell 22:787-797 (1980).

Altschul et al., "Basic local alignment search tool," J. Molec. Biol. 215:403 (1990).

Carrillo et al., "The multiple sequence alignment problem in biology," SIAM J Applied Math 48: 1073 (1988).

Devereux et al., "A comprehensive set of sequence analysis programs for the VAX," Nucleic Acids Research 12(I): 387 (1984).

Eisenberg et al., "Hydrophobic moments and protein structure," Faraday Symp. Chem. Soc. 17:109-120 (1982).

Gribskov et al., "Sigma factors from *E. coli, B. subtilis*, phage SP01, and phage T4 are homologous proteins," Nucl. Acids Res. 14: 6745-6763 (1986).

IUPAC-IUB, "Commission on biochemical nomenclature. A one-letter notation for amino acid sequences. Tentative rules," J. Biol. Chem. 243:3557-3559 (1968).

IUPAC-IUB, "Commission on biochemical nonmenclature symbols for amino-acid derivatives and peptides recommendations," Nomenclature Biochem. 11:1726-1732 (1972).

Needleman et al., "A general method applicable to the search for similarities in the amino acid sequence of two proteins," J Mol Biol. 48(3):443-453 (1970).

Pearson et al., "Improved tools for biological sequence comparison," Proc. Natl. Acad. Sci. USA 85: 2444-2448 (1988).

Schwartz and Dayhoff, eds., Atlas of Protein Sequence and Structure, National Biomedical Research Foundation, pp. 353-358 (1979).

Smith, T. and M. Waterman, "Comparison of biosequences," Adv. Appl. Math. 2:482 (1981).

Weiner et al., "Liposome-collagen gel matrix: a novel sustained drug delivery system," J Pharm Sci. 74(9): 922-925 (1985).

Gen Bank Accession No. NM_000131 Nucleotide (accessed on Jul. 21, 2008) (8 pages).

Gen Bank Accession No. NM_019616 Nucleotide (accessed on Jul. 21, 2008) (8 pages).

Uniprot accession No. P08709 (accessed on Apr. 24, 2009) (24 pages).

Partial International Search Report, issued Sep. 18, 2008, in connection with International Patent Application No. PCT/ US2008/004795.

International Search Report and Written Opinion, issued Jan. 19, 2009, in connection with International Patent Application No. PCT/US2008/004795.

Bowie et al., "Deciphering the message in protein sequences: tolerance to amino acid substitutions," Science 247:1306-1310 (1990).

Melton et al., "Location of the platelet binding site in zymogen coagulation factor IX," Blood Coagul. Fibrin. 12(4):237-243 (2001).

Neuenschwander, P. and J. Morrissey, "Roles of the membrane-interactive regions of factor VIIa and tissue factor," J. Biol. Chem. 269(11):8007-8013 (1994).

Wells, J., "Additivity of mutational effects in proteins," Biochem. 29(37):8509-8517 (1990).

Office Action, issued Jan. 28, 2011, in connection with Novo Norkisk, Inc. U.S. Appl. No. 12/066,619 (7 pages).

Search Report and Written Opinion, issued Mar. 24, 2011, in connection with Novo Nordisk Health Care AG EP Patent Application No. 10181064.6 (6 pages).

BioWorld Today, "Other news to note," BioWorld Today 21(243):2 (2010).

Madison et al., "Engineering factor VIIa molecules with improved therapeutic properties for treatment of patients with inhibitors," Haemophilia 16(Supp. 4):75, Abstract 17P48 (2010).

Examination Report, issued Feb. 26, 2010, in connection with related European Patent Application No. 08742852.0 (5 pages).

International Preliminary Report on Patentability, issued Jul. 16, 2010, in connection with corresponding International Patent Application No. PCT/US2009/002248 (15 pages).

Response to Examination Report, submitted Sep. 8, 2010, in connection with related European Patent Application No. 08742852.0 (6 pages).

Search Report and Written Opinion, issued Mar. 1, 2011, in connection with related Singapore Patent Application No. 200906724-0 (16 pages).

Examination Report, issued Mar. 17, 2011, in connection with corresponding New Zealand Patent Application No. 588322 (3 pages).

Notice of Acceptance, issued Apr. 4, 2011, in connection with corresponding South African Patent Application No. 2010/07063 (2 pages).

Allen et al. "A variant of recombinant factor VIIa with enhanced procoagulant and antifibrinolytic activities in an in vitro model of hemophilia," Arteriosclerosis Thrombosis and Vascular Biology 27(3):683-689 (2007).

Lauritzen et al., "rFVIIa and a new enhanced rFVIIa-analogue, NN1731, areduce bleeding in clopidogrel-treated and in thrombocytopenic rats," J. Thrombosis and Haemostasis. 7:651-657 (2009).

Moss et al., "Evaluation of the safety and pharmakokinetics of a fast-acting recombinant FVIIa analogue, NN1731, in healthy male subjects," J. Thrombosis and Haemostasis, 7:299-305 (2009).

Response to Search Report and Written Opinion, submitted Aug. 1, 2011, in connection with related Singapore Patent Application No. 200906724-0, 26 pages.

Official Action, issued Aug. 18, 2011, in connection with related Israeli Patent Application No. 201173, 9 pages.

Response to Examination Report, submitted Nov. 29, 2011, in connection with corresponding New Zealand Patent Application No. 588322, 44 pages.

Craik et al., "Proteases as therapeutics," Biochem. J. 435:1-16 (2011).

Cutler et al., "The significance of published polymorphisms in 14 cases of mild factor VII deficiency," Blood Coag. Fibrin. 16:91-95 (2005).

Ghosh et al., "Activity and regulation of factor VIIa analogs with increased potency at the endothelial cell surface," J. Thromb. Haemost. 5(2):336-346 (2007).

Henderson et al., "Response of factor VIII and IX-deficient blood to wild type and high membrane affinity mutant factor VIIa in an in vitro whole blood clotting assay: possible correlation to clinical outcome," Thromb. Haemost. 88:98-103 (2002).

Iino et al., "Functional consequences of mutations in Ser-52 and Ser-60 in human blood coagulation factor VII," Arch. Biochem. Biophys. 352(2):182-192 (1998).

Jin et al., "Factor VIIa's first epidermal growth factor-like domain's role in catalytic activity," Biochem. 38:1185-1192 (1999).

Persson et al., "Substitution of aspartic acid for methionine-306 in factor VIIa abolishes the allosteric linkage between the active site and the binding interface with tissue factor," Biochem. 40:3251-3256 (2001).

Petrovan et al., "Role of residue Phe225 in the cofactor-mediated, allosteric regulation of the serine protease coagulation factor VIIa," Biochem. 39:14457-14463 (2000).

Petrovan et al., "Role of zymogenicity-determining residues of coagulation factor VII/VIIa in cofactor interaction and macromolecular substrate recognition," Biochem. 41:9302-9309 (2002).

Shobe et al., "Regulation of the catalytic function of coagulation factor VIIa by a conformational linkage of surface residue Glu 154 to the active site," Biochem. 38:2745-2751 (1999).

Stone et al., "Large enhancement of functional activity of active site-inhibited factor VIIa due to protein dimerization: insights into mechanism of assembly/disassembly from tissue factor," Biochem. 44:6321-6330 (2005).

Taboureau et al., "Computational study of coagulation factor VIIa's affinity for phospholipid membranes," Eur. Biophys. J. 36:133-144 (2007).

Wulff et al., "Twenty two novel mutations of the factor VII gene in factor VII deficiency," Human Mutat. 15:489-496 (2000).

Search Report and Written Opinion, issued Jan. 6, 2012, in connection with corresponding Singapore Patent Application Serial No. 201007435-9, 21 pages.

Response to Examination Report, submitted Feb. 7, 2012, in connection with corresponding New Zealand Patent Application Serial No. 588322, 33 pages.

Notice of Acceptance, issued Feb. 28, 2012, in connection with corresponding New Zealand Patent Application Serial No. 588322, 1 page.

Official Action, issued May 3, 2012, in connection with corresponding Chineses Patent Application Serial No. 200980121895.1, 7 pages.

Response to Search Report and Written Opinion, submitted Jun. 6, 2012, in connection with corresponding Singapore Patent Application Serial No. 201007435-9, 59 pages.

Arbini et al., "A Thr$^{359}$Met mutation in factor VII of a patient with a hereditary deficiency causes defective secretion of the molecule," Blood 87(12):5085-5094 (1996).

Bharadwaj et al., "Factor VII central: a novel mutation in the catalytic domain that reduces tissue factor binding, impoairs activation by factor Xa, and abolishes amidolytic and coagulant activity," J. Biol Chem. 271(48):30685-30691 (1996).

Chafa et al., "Homozygous nonsense mutation (Cys72 →stop) in the human F7 gene: a not life-threatening mutation despite the absence of circulating factor VII," J. Thromb. Haemost. 3(1):175-177 (2005).

Chaing et al., "Severe factor VII deficiency caused by mutations abolishing the cleavage site for activation and altering binding to tissue factor," Blood 83(12):3524-3535 (1994).

D'Andrea et al., "Molecular characterization of a factor VII deficient patient supports the importance of the second epidermal growth factor-like domain," Haematologica 89(8):979-984 (2004).

Etro et al., "The Gly331Ser mutation in factor VII in Europe and the Middle East," J. Hematol. 88(12):1434-1436 (2005).

Fromovich-Amit et al., "Characterization of mutations causing factor VII deficiency in 61 unrelated Israeli patients," J. Thromb. Haemost. 2(10):1774-1781 (2004).

Furlan Freguia et al., "Comparison among natural (Arg$^{304}$Gln, Arg$^{304}$Trp) and artificial (Arg$^{290}$His, Arg$^{290}$Lys) mutations in coagulation factor VII loops," J. Thromb. Haemost. 1(11):2455-2457 (2003).

Furlan Freguia et al., "Characterization of mild coagulation factor VII deficiency: activity and clearance of the Arg$^{315}$Trp and Arg$^{315}$Lys variants in the Cys$^{310}$-Cys$^{329}$ loop (c170s)," Haematologica 89(12):1504-1509 (2004).

Hahn et al., "Population genetic and phylogenetic evidence for positive selection on regulatory mutations at the factor VII locus in humans," Genetics 167(2):867-877 (2004).

Hunault et al., "Characterization of two naturally occurring mutations in the second epidermal growth factor-like domain of factor VII," Blood 93(4):1237-1244 (1999).

Hunault et al., "Mechanism underlying factor VII deficiency in Jewish populations with the Ala$^{244}$Val mutation," Br. J. Haematol. 105(4):1101-1108 (1999).

Katsumi et al., "Severe factor VII deficiency caused by a novel mutation His$^{348}$ to Gln in the catalytic domain," Thromb. Haemost. 83(2):239-243 (2000).

Kavlie et al, "Characterization of a factor VII molecule carrying a mutation in the second epidermal growth factor-like domain," Thromb. Haemost. 79(6):1136-1143 (1998).

Kavlie et al., "A novel gene mutation in the 60s loop of human coagulation factor VII—inhibition of interdomain crosstalk," Thromb. Haemost. 91(1):28-37 (2004).

Leonard et al., "Factor VII deficiency caused by a structural variant N57D of the first epidermal growth factor domain," Blood 91(1):142-148 (1998).

Mariani et al., "Clinical phenotypes and factor VII genotype in congenital factor VII deficiency," Thromb. Haemost. 3:481-487 (2005).

Matsushita et al., "Impaired human tissue factor-mediated activity in blood clotting factor VII$_{Nagoya}$ (Arg$^{304}$ → Trp)," J. Biol. Chem. 269(10):7355-7363 (1994).

McVey et al., "Factor VII Deficiency and the FVII Mutation Database," Human Mutation 17(1):3-17 (2001).

Menegatti et al., "A rare inherited coagulation disorder: combined homozygous factor VII and factor X deficiency," Am. J. Hematol. 77(1):90-91 (2004).

Millar et al., "Molecular analysis of the genotype-phenotype relationship in factor VII deficiency," Hum. Genet.107(4):327-342 (2000).

Olsen et al., "Prevention of β strand movement into a zymogen-like position does not confer higher activity to coagulation factor VIIa," Biochem. 43:14096-14103 (2004).

Peyvandi et al., "Molecular characterisation and three-dimensional structural analysis of mutations in 21 unrelated families with inhereited factor VII deficiency," Thromb. Haemost. 84(2):250-257 (2000).

Peyvandi et al., "Two naturally occurring mutations on FVII gene (S363I-W364C) altering intrinsic catalytic activity," Thromb. Haemost. 88(5):750-755 (2002).

Ruan et al., "Overexpression of *Bso*BI restriction endonuclease in *E. coli*, purification of the recombinant *Bso*BI, and identification of catalytic residues of *Bso*BI by random mutagenesis," Gene 188:35-39 (1997).

Shikata et al., "Association of pharmacokinetic (CYP2C9) and pharmacodynamic (factors II, VII, IX, and X; proteins S and C; and γ-glutamyl carboxylase) gene variants with warfarin sensitivity," Haemost. Thromb. Vasc. Biol. 103(7):2630-2635 (2004).

Takamiya et al., "Human factor VII deficiency caused by S339C mutation located adjacent to the specificity pocket of the catalytic domain," Clin. Lab. Haematol. 24(4):233-238 (2002).

Takamiya et al., "Molecular mechanism of dysfunctional factor VII associated with the homozygous missense mutation 331Gly to Ser," Thromb. Haemost. 93(3):414-419 (2005).

Wells, "Additivity of mutational effects in proteins," Biochem. 29(37):8509-8517 (1990).

Wu et al., "Characterization of a Cys$^{329}$Gly mutation causing hereditary factor VII deficiency," Acta Haematol. 116(2):96-100 (2006).

Zaccolo et al., "An approach to random mutagenesis of DNA using mixtures of triphosphate derivatives of nucleoside analogues," J. Mol. Biol. 255:589-603 (1996).

Search and Examination Report, issued Jul. 27, 2012, in connection with corresponding Singapore Patent Application Serial No. 201007435-9 (11 pages).

Official Action, issued Nov. 21, 2012, in connection with Colombian Patent Application Serial. No. 10.127.271, 10 pages.

English language translation of an Examination Report, issued Nov. 27, 2012, in connection with Eurasian Patent Application Serial No. 201001628, 3 pages.

Notice of Allowance, reported Mar. 8, 2013, in connection with corresponding Mexican Patent Application No. MX/a/2010/011170 [1 page].

* cited by examiner

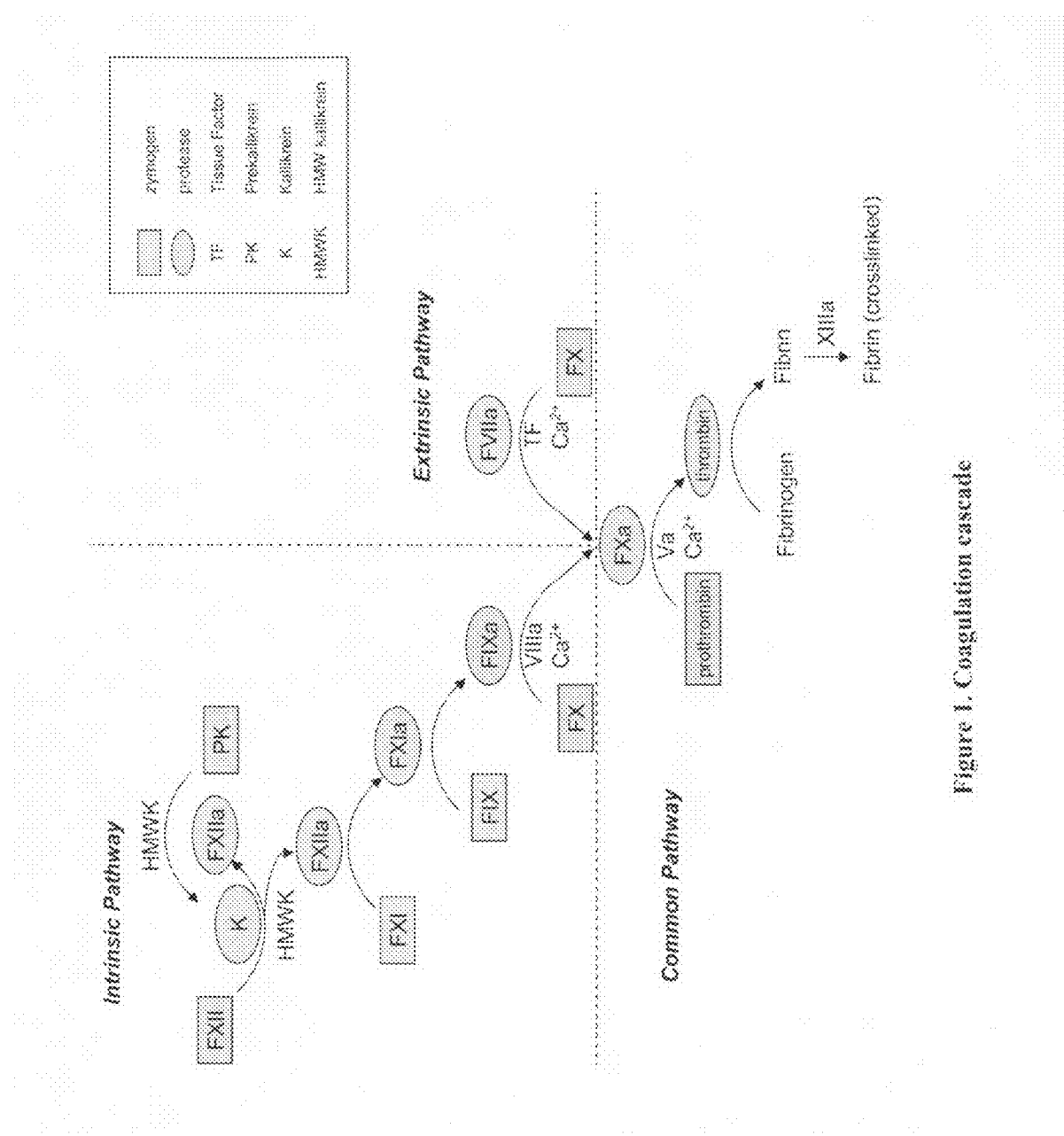
Figure 1. Coagulation cascade

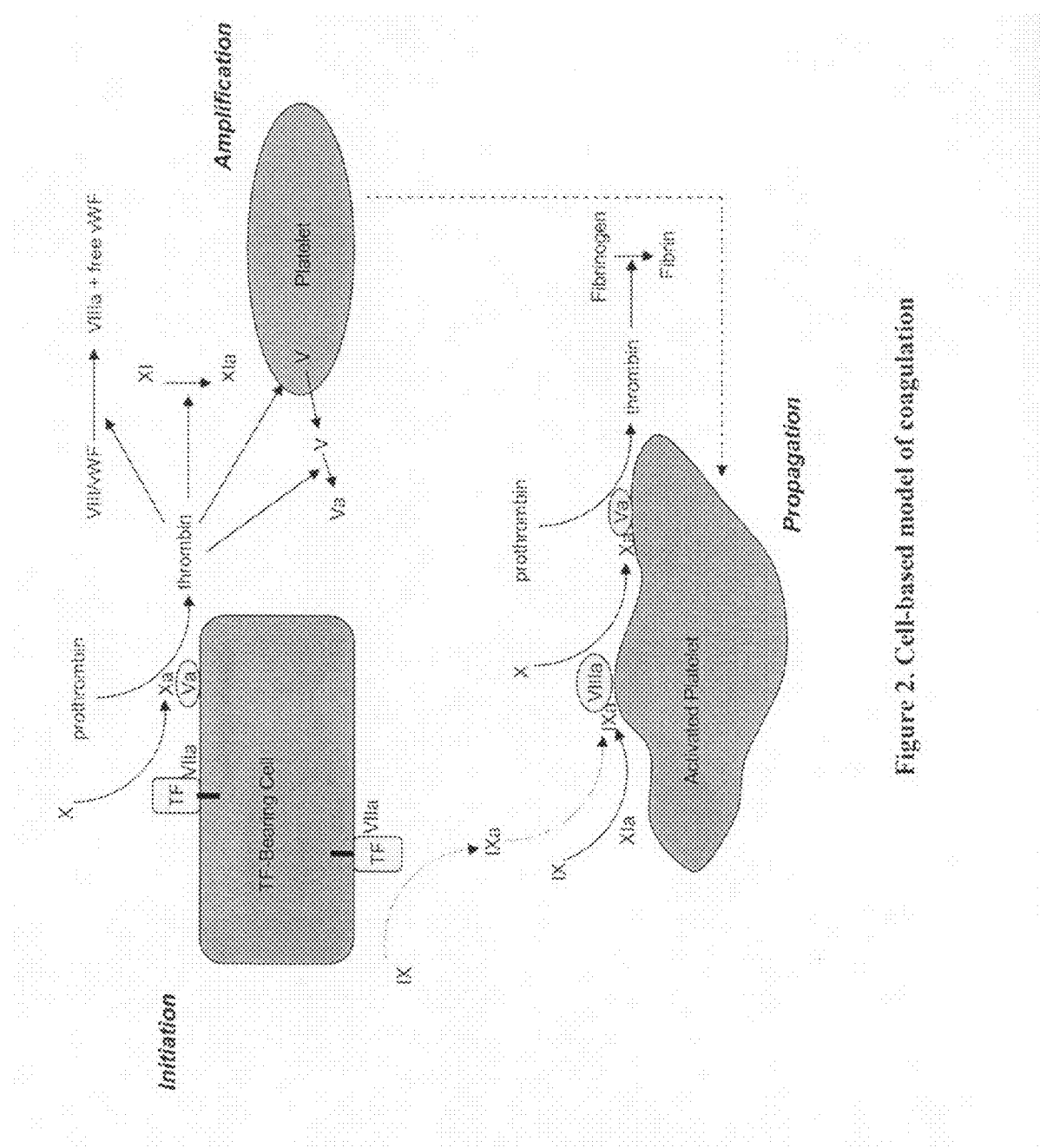
Figure 2. Cell-based model of coagulation

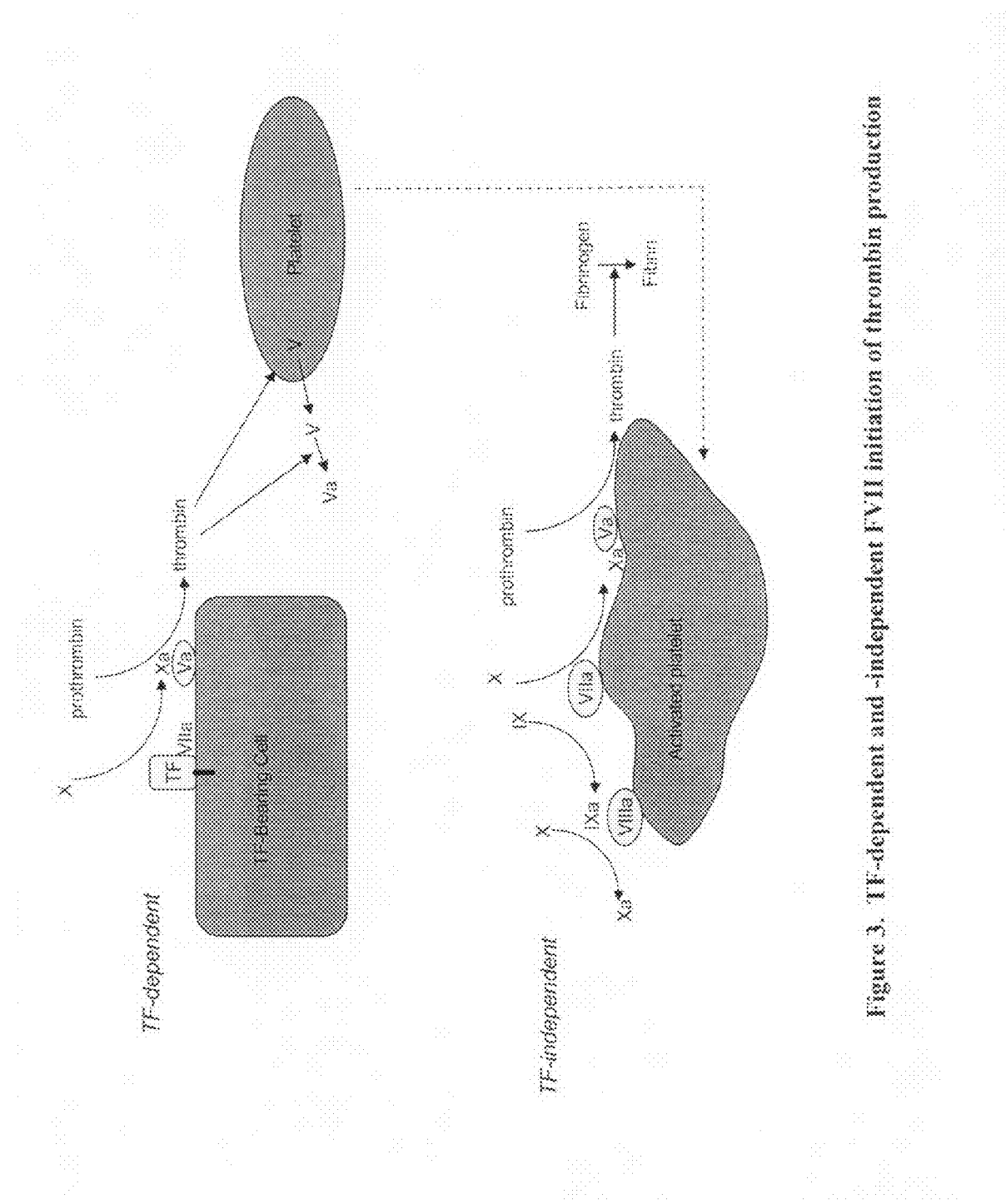
Figure 3. TF-dependent and -independent FVII initiation of thrombin production

FACTOR VII POLYPEPTIDES THAT ARE MODIFIED AND USES THEREOF

RELATED APPLICATIONS

Benefit of priority is claimed to U.S. Provisional Application Ser. No. 61/124,021, to Edwin Madison and Christopher Thanos, entitled "FACTOR VII POLYPEPTIDES THAT ARE MODIFIED AND USES THEREOF," filed Apr. 11, 2008.

This application is related to corresponding International Application No. PCT/US09/002,248 to Edwin Madison and Christopher Thanos, entitled "FACTOR VII POLYPEPTIDES THAT ARE MODIFIED AND USES THEREOF," filed Apr. 10, 2009, which also claims priority to U.S. Provisional Application Ser. No. 61/124,021.

The subject matter of the above-referenced applications is incorporated by reference in its entirety.

The subject matter of U.S. application Ser. No. 12/082,662, to Edwin Madison, Christopher Thanos, Sandra Waugh Ruggles and Shaun Coughlin, entitled "MODIFIED FACTOR VII POLYPEPTIDES AND USES THEREOF," filed Apr. 11, 2008, and corresponding International Application No. PCT/US2008/04795 to Edwin Madison, Christopher Thanos, Sandra Waugh Ruggles and Shaun Coughlin, entitled "MODIFIED FACTOR VII POLYPEPTIDES AND USES THEREOF," filed Apr. 11, 2008, also is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Apr. 10, 2009, is identical, 1200 kilobytes in size, and titled 4919SEQ.001.TXT.

FIELD OF THE INVENTION

Modified therapeutic proteins are provided. In particular modified Factor VII polypeptides, which includes Factor VIIa and other forms of Factor VII, and uses thereof are provided.

BACKGROUND

Hemostasis is the complex physiological process that leads to the cessation of bleeding. Platelets, plasma proteins, and blood vessels and endothelial cells are the three components of this process that each play an important role in the events that immediately follow tissue injury and which, under normal circumstances, results in the rapid formation of a clot. Central to this is the coagulation cascade, a series of proteolytic events in which certain plasma proteins (or coagulation factors) are sequentially activated in a "cascade" by another previously activated coagulation factor, leading to the rapid generation of thrombin. The large quantities of thrombin produced in this cascade then function to cleave fibrinogen into the fibrin peptides that are required for clot formation.

The coagulation factors circulate as inactive single-chain zymogens, and are activated by cleavage at one or more positions to generate a two-chain activated form of the protein. Factor VII (FVII), a vitamin K-dependent plasma protein, initially circulates in the blood as a zymogen. The FVII zymogen is activated by proteolytic cleavage at a single site, $Arg^{152}$-$Ile^{153}$, resulting is a two-chain protease linked by a single disulphide bond (FVIIa). FVIIa binds its cofactor, tissue factor (TF), to form a complex in which FVIIa can efficiently activate factor X (FX) to FXa, thereby initiating the series of events that result in fibrin formation and hemostasis.

While normal hemostasis is achieved in most cases, defects in the process can lead to bleeding disorders in which the time taken for clot formation is prolonged. Such disorders can be congenital or acquired. For example, hemophilia A and B are inherited diseases characterized by deficiencies in factor VIII (FVIII) and factor IX (FIX), respectively. Replacement therapy is the traditional treatment for hemophilia A and B, and involves intravenous administration of FVIII or FIX, either prepared from human plasma or as recombinant proteins. In many cases, however, patients develop antibodies (also known as inhibitors) against the infused proteins, which reduces or negates the efficacy of the treatment. Recombinant FVIIa (Novoseven® (Coagulation Factor VIIa (Recombinant))) has been approved for the treatment of hemophilia A or B patients that have inhibitors to FVIII or FIX, and also is used to stop bleeding episodes or prevent bleeding associated with trauma and/or surgery. Recombinant FVIIa also has been approved for the treatment of patients with congenital FVII deficiency, and is increasingly being utilized in off-label uses, such as the treatment of bleeding associated with other congenital or acquired bleeding disorders, trauma, and surgery in non-hemophilic patients.

The use of recombinant FVIIa to promote clot formation underlines its growing importance as a therapeutic agent. FVIIa therapy leaves significant unmet medical need. For example, based on clinical trial data, an average of 3 doses of FVIIa over a 6 hour or more time period are required to manage acute bleeding episodes in hemophilia patients. More efficacious variants of FVIIa are needed to reduce these requirements. Therefore, among the objects herein, it is an object to provide modified FVII polypeptides that are designed to have improved therapeutic properties.

SUMMARY

Provided herein are modified Factor VII (FVII) polypeptides. In particular, provided herein are modified FVII polypeptides that exhibit procoagulant activities. The FVII polypeptides are modified in primary sequence compared to an unmodified FVII polypeptide, and can include amino acid insertions, deletions and replacements. Modified FVII polypeptides provided herein include FVII polypeptides that exhibit those that have increased resistance to inhibitors such as antithrombin III (AT-III) and tissue factor pathway inhibitor (TFPI), those that have increased resistance to the inhibitory effects of $Zn^{2+}$, those that have increased catalytic activity in the presence and/or absence of TF, those that have improved pharmacokinetic properties, such as increased half-life, those that have increased binding and/or affinity for the platelet surface, those that have increased binding and/or affinity for serum albumin, and those that have increased binding and/or affinity for platelet integrin $\alpha_{IIb}\beta_3$. The modified FVII polypeptides can contain any combination of modifications provided herein, whereby one or more activities or properties of the polypeptide are altered compared to an unmodified FVII polypeptide. Typically the modified FVII polypeptide retains procoagulant activity. Also provided herein are nucleic acid molecules, vectors and cells that encode/express modified FVII polypeptides. Pharmaceutical compositions, articles of manufacture, kits and methods of treatment also are provided herein. FVII polypeptides include allelic and species variants and polypeptides and other variants that have modifications that affect other activities and/or properties. Also included are active fragments of the FVII polypeptides that include a modification provided herein. Exemplary of FVII polypeptides are those that include the sequence of amino acids set forth in SEQ ID NO:3, as well as variants thereof having 60%, 65%, 70%, 75%, 80%, 85%, 88%, 90%, 91%, 92%, 93%, 94%, 95%, 96%, 97%, 98%, 99% or more sequence identity therewith.

Provided herein are modified factor VII (FVII) polypeptides that contain a modification in a FVII polypeptide at position Q286 in a FVII polypeptide having a sequence of amino acids set forth in SEQ ID NO:3 or in corresponding residues in a FVII polypeptide. The modification can be an amino acid replacement, amino acid insertion(s) or deletion(s), or combination thereof. In instances where the modification is an amino acid replacement, replacement can be by a basic amino acid (e.g. Arg (R), Lys (K) and His (H)) or an amino acid selected from among Arg (R), Lys (K) His (H), Tyr (Y), Gly (G), Phe (F), Met (M), Ile (I), Leu (L), Val (V), Pro (P), Glu (E), Trp (W), Asp (D), and Cys (C). Exemplary of such amino acid replacements include Q286R, Q286K, Q286H, Q286Y, Q286G, Q286F, Q286M, Q286I, Q286L, Q286V, Q286P, Q286E, Q286W, Q286D, and Q286C. Such modifications can be made in an unmodified FVII polypeptide containing a sequence set forth in any of SEQ ID NOS: 1-3, or an allelic or species variant thereof, or a variant having at least 60% sequence identity with the FVII of any of SEQ ID NOS: 1-3, or an active fragment of a FVII polypeptide that comprises a sequence of amino acids set forth in any SEQ ID NOS: 1-3, or an allelic or species variant thereof, or a variant having at least 60% sequence identity with the FVII of any of SEQ ID NOS: 1-3. For example, a modified FVII polypeptide can be an active fragment that contains replacement at a position corresponding to position Q286 in a FVII polypeptide.

In some examples, the modified FVII polypeptides provides herein contain an amino acid replacement at a position corresponding to position 286 in a FVII polypeptide having the sequence of amino acids set forth in SEQ ID NO:3 or in a corresponding residue in a FVII polypeptide, wherein the modification is replacement at position 286 by a basic amino acid that results in a modified FVII polypeptide that exhibits increased coagulant activity compared to the FVII polypeptide that does not have the modification at position 286. The basic amino acid can be selected from among Arg (R), Lys (K) and His (H). For example, a modified FVII polypeptide provided herein can contain a replacement of Gln (Q) with Arg (R) at position 286.

In some examples, the modified FVII polypeptides have only the single modification at position 286. In other examples, the modified FVII polypeptides also contain one or more further modifications at another position in the FVII polypeptide. The further modification can be an amino acid replacement, insertion or deletion. For example, the further modification can be an amino acid replacement at a position corresponding to a position selected from among A51, S52, P54, S60, Q66, Y68, K109, S119, A122, G124, T130, E132, V158, K161, A175, D196, K197, K199, R202, H216, S222, G237, T239, H257, Q286, L287, R290, A292, A294, E296, M298, L305, S314, G318, P321, K337, K341, Q366, H373, F374, E394, P395 and R396. Exemplary of such modifications include D196K, D196R, D196A, D196Y, D196F, D196W, D196L, D196I, K197Y, K197A, K197E, K197D, K197L, K197M, K197I, K197V, K197F, K197W, K199A, K199D, K199E, G237W, G237T, G237I, G237V, T239A, R290A, R290E, R290D, R290N, R290Q, R290K, R290M, R290V, K341E, K341R, K341Q, K341N, K341M, K341D, G237T238insA, G237T238insS, G237T238insV, G237T238insAS, G237T238insSA, D196K197insK, D196K197insR, D196K197insY, D196K197insW, D196K197insA, D196K197insM, K197I198insE, K197I198insY, K197I198insA, K197I198insS, T239S, T239N, T239Q, T239V, T239L, T239H, T239I, L287T, M298Q, P321K, P321E, P321Y, P321S, Q366D, Q366E, Q366N, Q366T, Q366S, Q366V, Q366I, Q366L, Q366M, H373D, H373E, H373S, H373L, H373I, H373F, H373A, K161S, K161A, K161V, H216S, H216A, H216K, H216R, S222A, S222K, S222V, S222N, S222E, S222D, H257A, H257S, Gla Swap FIX, {Gla Swap FIX/E40L}, {Gla Swap FIX/K43I}, {Gla Swap FIX/Q44S}, {Gla Swap FIX/M19K}, {Gla Swap FIX/M19K/E40L/K43I/Q44S}, Gla Swap FX, Gla Swap Prot C, Gla Swap Prot S, Gla Swap Thrombin, S52A, S60A, E394N, P395A, R396S, R202S, A292N, A294S, G318N, A175S, K109N, A122N, G124S, A51N, T130N, E132S, S52N, P54S, S119N, L121S, T128N, P129A, Q66N, Y68S, S103S111delinsQRLMEDICLPRWGCLWEDDF, H115S126delinsQRLMEDICLPRWGCLWEDDF, T128P134delinsQRLMEDICLPRWGCLWEDDF, S103S111delinsIEDICLPRWGCLWE, H115S126delinsIEDICLPRWGCLWE, T128P134delinsIEDICLPRWGCLWE, S103S111delinsDICLPRWGCLWED, H115S126delinsDICLPRWGCLWED, T128P134delinsDICLPRWGCLWED, P406insIEDICLPRWGCLW, P406insGGGSIEDICLPRWGCLW, P406insDICLPRWGCLWED, P406insGGGSDICLPRWGCLWED, S103S111delinsSFGRGDIRNV, H115S126delinsSFGRGDIRNV, T127P134delinsSFGRGDIRNV, P406insCSFGRGDIRNVC, P406insGGGSCSFGRGDIRNVC, V158T, V158D, L287T, E296V, M298K and M298Q.

Exemplary of the modified FVII polypeptides provided herein are those that contain modifications Q286R/M298Q, Q286R/Gla Swap FIX, Q286R/H257A, Q286R/S222A, Q286R/S222A/H257A, Q286R/S222A/Gla Swap FIX, Q286R/H257A/Gla Swap FIX, Q286R/S222A/H257A/Gla Swap FIX, Q286R/M298Q/K341Q, Q286R/M298Q/K199E, Q286R/M298Q/Gla Swap FIX, Q286R/Q366V, Q286R/A292N/A294S/Q366V, A175S/Q286R/Q366V, S222A/Q286R/Q366V, H257S/Q286R, H257S/Q286R/Q366V, S222A/H257A/Q286R/Q366V, Q286R/H373A, S222A/H257A/Q286R/M158Q, Q286R/K341D, Q286R/Q366D, Q286R/Q366N, Q286R/M298Q/Q366D, Q286R/M298Q/Q366N, Q286R/H373F, Q286R/M298Q/H373F, {Gla Swap FIX/E40L}/Q286R/M298Q, {Gla Swap FIX/K43I}/Q286R/M298Q, {Gla Swap FIX/Q44S}/Q286R/M298Q, {Gla Swap FIX/M19K}/Q286R/M298Q, {Gla Swap FIX/M19K/E40L/K43V/Q44S}/Q286R/M298Q, T128N/P129A/Q286R, T128N/P129A/Q286R/M298Q, T128N/P129A/Q286R/H373F, V158D/Q286R/E296V/M298Q, Gla Swap FIX/T128N/P129A/S222A/Q286R, Gla Swap FIX/T128N/P129A/Q286R/M298Q, T128N/P129A/S222A/H257A/Q286R/M298Q, T128N/P129A/Q286R/M298Q/H373F, S52A/S60A/Q286R, Gla Swap FIX/S52A/S60A/S222A/Q286R, S52A/S60A/Q286R/M298Q, Gla Swap FIX/S52A/S60A/Q286R/M298Q, S52A/S60A/S222A/H257A/Q286R/M298Q, S52A/S60A/Q286R/H373F/, S52A/S60A/Q286R/M298Q/H373F, T239V/Q286R, Gla Swap FIX/S222A/

T239V/Q286R, T239V/Q286R/M298Q, S222A/T239V/ H257A/Q286R/M298Q, Gla Swap FIX/T239V/Q286R/ M298Q, T239V/Q286R/H373F, T239V/Q286R/M298Q/ H373F, T239I/Q286R, Gla Swap FIX/S222A/T239I/Q286R, T239I/Q286R/M298Q, S222A/T239I/H257A/Q286R/ M298Q, Gla Swap FIX/T239I/Q286R/M298Q, T239I/ Q286R/H373F, T239V/Q286R/M298Q/H373F, Gla Swap FIX/S222A/Q286R/H373F, Gla Swap FIX/S222A/Q286R/ M298Q, Gla Swap FIX/S222A/Q286R/M298Q/H373F, V158D/Q286R/E296V/M298Q/H373F, H257A/Q286R/ M298Q, H257S/Q286R/M298Q, Gla Swap FIX/S222A/ H257S/Q286R/, S222A/H257S/Q286R/M298Q, H257S/ Q286R/M298Q/H373F, S222A/Q286R/M298Q/H373F, S222A/Q286R/M298Q, T128N/P129A/A175S/Q286R, A122N/G124S/A175S/Q286R, Gla Swap FIX/T128N/ P129A/A175S/S222A/Q286R, Gla Swap FIX/A122N/ G124S/A175S/S222A/Q286R, T128N/P129A/A175S/ Q286R/M298Q, A122N/G124S/A175S/Q286R/M298Q, T128N/P129A/A 175S/S222A/H257A/Q286R/M298Q, A122N/G124S/A175S/S222A/H257A/Q286R/M298Q, T128N/P129A/A175S/Q286R/M298Q/H373F, A122N/ G124S/A175S/Q286R/M298Q/H373F, {Gla Swap FIX/ K43I}/T128N/P129A/Q286R/M298Q, T128N/P129A/ Q286R/M298Q/Q366N, {Gla Swap FIX/K43I}/Q286R/ M298Q/Q366N, {Gla Swap FIX/K43I}/T128N/P129A/ Q286R/M298Q/Q366N, V158D/Q286R/E296V/M298Q, T128N/P129A/Q286R/M298Q/Q366N/H373F, T239V/ Q286R/M298Q/Q366N, T239I/Q286R/M298Q/Q366N, T128N/P129A/T239V/Q286R/M298Q, T128N/P129A/ S222A/T239V/H257A/Q286R/M298Q, T128N/P129A/ T239V/Q286R/M298Q/H373F, T128N/P29A/T239I/ Q286R/M298Q or T128N/P129A/T239I/Q286R/M298Q/ H373F.

Provided herein are modified FVII polypeptides containing two or more modifications in a FVII polypeptide, allelic or species variant thereof or active fragments thereof. At least one of the modifications in such polypeptides is at a position corresponding to position Q286 in a FVII polypeptide having a sequence of amino acids set forth in SEQ ID NO:3 or in corresponding residues in a FVII polypeptide, providing that the modification at position Q286, alone or in combination with any other modification, does not result in introduction of a new glycosylation site compared to the unmodified FVII polypeptide. Such modifications can be an amino acid replacement, insertion or deletion. For example, the modification at position Q286 can be a replacement by an amino acid selected from among Arg (R), Lys (K) His (H), Tyr (Y), Gly (G), Phe (F), Met (M), Ile (I), Leu (L), Val (V), Pro (P), Glu (E), Trp (W), Asp (D), and Cys (C). In some examples, the modification is Q286R. The one or more other modifications can be selected from among D196K, D196R, D196A, D196Y, D196F, D196W, D196L, D196I, K197Y, K197A, K197E, K197D, K197L, K197M, K197I, K197V, K197F, K197W, K199A, K199D, K199E, G237W, G237T, G237I, G237V, T239A, R290A, R290E, R290D, R290N, R290Q, R290K, R290M, R290V, K341E, K341R, K341Q, K341N, K341M, K341D, G237T238insA, G237T238insS, G237T238insV, G237T238insAS, G237T238insSA, D196K197insK, D196K197insR, D196K197insY, D196K197insW, D196K197insA, D196K197insM, K197I198insE, K197I198insY, K197I198insA, K197I198insS, T239S, T239N, T239Q, T239V, T239L, T239H, T239I, L287T, P321K, P321E, P321Y, P321S, Q366D, Q366E, Q366N, Q366T, Q366S, Q366V, Q366I, Q366L, Q366M, H373D, H373E, H373S, H373F, H373A, K161S, K161M, K161V, H216S, H216A, H216K, H216R, S222A, S222K, S222V, S222N, S222E, S222D, H257A, H257S, Gla Swap FIX, {Gla Swap FIX/E40L}, {Gla Swap FIX/K43I}, {Gla Swap FIX/Q44S}, {Gla Swap FIX/M19K}, {Gla Swap FIX/M19K/E40L/K43I/Q44S}, Gla Swap FX, Gla Swap Prot C, Gla Swap Prot S, Gla Swap Thrombin, S52A, S60A, E394N, P395A, R396S, R202S, A292N, A294S, G318N, A175S, K109N, A122N, G124S, A51N, T130N, E132S, S52N, P54S, S119N, L121S, T128N, P129A, Q66N, Y68S, S103S111delinsQRLMEDICLPRWGCLWEDDF, H115S126delinsQRLMEDICLPRWGCLWEDDF, T128P134delinsQRLMEDICLPRWGCLWEDDF, S103S111delinsIEDICLPRWGCLWE, H115S126delinsIEDICLPRWGCLWE, T128P134delinsIEDICLPRWGCLWE, S103S111delinsDICLPRWGCLWED, H115S126delinsDICLPRWGCLWED, T128P134delinsDICLPRWGCLWED, P406insIEDICLPRWGCLW, P406insGGGSIEDICLPRWGCLW, P406insDICLPRWGCLWED, P406insGGGSDICLPRWGCLWED, S103S111delinsSFGRGDIRNV, H115S126delinsSFGRGDIRNV, T127P134delinsSFGRGDIRNV, P406insCSFGRGDIRNVC, P406insGGGSCSFGRGDIRNVC, V158T, V158D, L287T, E296V, M298K and M298Q.

In some examples, the modified FVII polypeptides contain a modification at a position corresponding P54, Q66, L121, A122, P129 or E132 in a FVII polypeptide having a sequence of amino acids set forth in SEQ ID NO:3 or in corresponding residues in a FVII polypeptide. Exemplary modifications include P54Q, Q66N, L121S, A122N, P129A and E132S. In some examples, modified FVII polypeptides containing a modification at a position corresponding P54, Q66, L121, A122, P129 or E132 also contain one or more further modifications, including amino acid replacements, insertions or deletions at another position in the FVII polypeptide. Such modifications include P54S, S52N, Y58S, S119N, G124S, T128N, T130N, V158D, A175S, S222A, G241S, E296V, M298Q, E394N, P395A, R396S, G318N and Q366V. Thus, exemplary of the combination modifications in a FVII polypeptide provided herein are S119N/L121S, T128N/ P129A, A122N/G124S, A122N/G124S/A175S, A122N/ G124S/E394N/P395A/R396S, A122N/G124S/E394N/ P395A/R396S/G318N, A122N/G124S/E394N/P395A/ R396S, S52N/P54S/A122N/G124S/E394N/P395A/R396S, S52N/P54S, S119N/L121S/A175S, T128N/P129A/A175S, T130N/E132S, Q66N/Y68S, T128N/P129A/V158D/ E296V/M298Q, T128N/P129A/S222A, T128N/P129A/ A175S/Q366V, A122N/G124S/A175S/Q366V, T128N/ P129A/A175S/S222A, A122N/G124S/A175S/S222A, T128N/P129A/M298Q and T128N/P129A/M298Q/H373F.

Also provided herein are modified FVII polypeptides containing a modification corresponding to T239S, T239Q, T239V, T239L, T239H, T239I, P321K, P321E, P321Y, P321S, Q366D, Q366N, Q366V, Q366I, Q366L, Q366M, H373D, H373E, H373S, H373F, H373A, K161S, K161V, H216S, H216K, H216R, S222A, S222K, S222V, S222D, S222N, S222E or H257S in a FVII polypeptide having a sequence of amino acids set forth in SEQ ID NO:3 or in corresponding residues in a FVII polypeptide. Further, such modified FVII polypeptides also can contain one or more further modifications at another position, such as amino acid position A51, S52, P54, S60, Q66, Y68, K109, S119, A122, G124, T130, E132, V158, K161, A175, D196, K197, K199, R202, H216, S222, G237, T239, H257, Q286, L287, R290, A292, A294, E296, M298, L305, S314, G318, P321, K337, K341, Q366, H373, F374, E394, P395 and R396. Exemplary modifications at these positions include Q286N, Q286E, Q286D, Q286S, Q286T, Q286R, Q286K, Q286A, Q286V, Q286M, Q286L, Q286Y, D196K, D196R, D196A, D196Y, D196F, D196W, D196L, D196I, K197Y, K197A, K197E, K197D, K197L, K197M, K197I, K197V, K197F, K197W, K199A, K199D, K199E, G237W, G237T, G237I, G237V, T239A, R290A, R290E, R290D, R290N, R290Q, R290K, R290M, R290V, K341E, K341R, K341Q, K341N, K341M, K341D, G237T238insA, G237T238insS, G237T238insV, G237T238insAS, G237T238insSA, D196K197insK, D196K197insR, D196K197insY, D196K197insW, D196K197insA, D196K197insM, K197I198insE, K197I198insY, K197I198insA, K197I198insS, T239S, T239N, T239Q, T239V, T239L, T239H, T239I, L287T, P321K, P321E, P321Y, P321S, Q366D, Q366E, Q366N, Q366T, Q366S, Q366V, Q366I, Q366L, Q366M, H373D, H373E, H373S, H373F, H373A, K161S, K161A, K161V, H216S, H216A, H216K, H216R, S222A, S222K, S222V, S222N, S222E, S222D, H257A, H257S, Gla swap FIX, Gla swap FX, Gla Swap Prot C, Gla Swap Prot S, Gla swap Thrombin, Gla Swap FIX, {Gla Swap FIX/E40L}, {Gla Swap FIX/K43I}, {Gla Swap FIX/Q44S}, {Gla Swap FIX/M19K}, {Gla Swap FIX/M19K/E40L/K43I/Q44S}, S52A, S60A, E394N, P395A, R396S, R202S, A292N, A294S, G318N, A175S, K109N, A122N, G124S, A51N, T130N, E132S, S52N, P54S, S119N, L121S, T128N, P129A, Q66N, Y68S, S103S111delinsQRLMEDICLPRWGCLWEDDF, H115S126delinsQRLMEDICLPRWGCLWEDDF, T128P134delinsQRLMEDICLPRWGCLWEDDF, S103 S111delinsIEDICLPRWGCLWE, H115S126delinsIEDICLPRWGCLWE, T128P134delinsIEDICLPRWGCLWE, S103S111delinsDICLPRWGCLWED, H115S126delinsDICLPRWGCLWED, T128P134delinsDICLPRWGCLWED, P406insIEDICLPRWGCLW, P406insGGGSIEDICLPRWGCLW, P406insDICLPRWGCLWED, P406insGGGSDICLPRWGCLWED, S103S111delinsSFGRGDIRNV, H115S126delinsSFGRGDIRNV, T127P134delinsSFGRGDIRNV, P406insCSFGRGDIRNVC, P406insGGGSCSFGRGDIRNVC, V158T, V158D, L287T, M298K and M298Q. The resulting combination modifications can include Q366D/H373E, Q366V/H373V, Q366V/H373L, Q366V/H373I, S222K/H257A, H216A/S222A, S222S/Gla Swap FIX, S222A/H257A/Gla Swap FIX, S222A/M298Q, S222A/H257A/M298Q, S222A/A292N/A294S/Q366V, A 175S/S222A/Q366V, S222A/Q366V, H257S/Q366V, S222A/H373A, M298Q/H373F, S52A/S60A/S222A, S222A/T239V, V158D/T239V/E296V/M298Q, S222A/T239I, V158D/E296V/M298Q/H373F, Gla Swap FIX/Q366V, M298Q/Q366N/H373F, T239V/M298Q/H373F and T239I/M298Q/H373F.

Provided herein are modified FVII polypeptides containing two or more modifications in a FVII polypeptide, allelic and species variant thereof or active fragments thereof, wherein the two or more amino acid modifications are selected from among amino acid modifications corresponding to H216A, H257A, E394N, P395A, R396S, K109N, A292N, A175S, H257A and Gla Swap FIX. For example, modified FVII polypeptides provided herein include those with modifications selected from among H216A/H257A, E394N/P395A/R396S and K109N/A175S. Further, a modification corresponding to M298Q or A294S also can be included. Thus, also provided herein are modified FVII polypeptides containing modifications selected from among H216A/H257A, E394N/P395A/R396S and K109N/A175S. In some examples, the modified FVII polypeptides also contain a modification corresponding to M298Q or A294S. This can result in, for example, a modified FVII polypeptide containing the modifications H257A/M298Q or K109N/A292N/A294S. Also provided are modified FVII polypeptides containing modifications corresponding to S52A/S60A/V158D/E296V/M298Q or V158D/T239I/E296V/M298.

In some examples, the modified FVII polypeptides provided herein contain a serum albumin binding sequence, such as a sequence of amino acids set forth in any of SEQ ID NOS: 103-109, or a sufficient portion thereof to effect serum albumin binding. Such modified FVII polypeptides can exhibit increased affinity for or binding to serum albumin binding compared with the unmodified FVII polypeptide. For example, modified FVII polypeptides containing a serum albumin binding sequence can exhibit at least about or 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more increased affinity for or binding to serum albumin binding. The serum albumin binding sequence can replace a contiguous sequence of amino acid residues of the unmodified FVII polypeptide. Modified FVII polypeptides containing a serum albumin binding sequence can contain a modification selected from among S103S111delinsQRLMEDICLPRWGCLWEDDF, H115S126delinsQRLMEDICLPRWGCLWEDDF, T128P134delinsQRLMEDICLPRWGCLWEDDF, S103S111delinsIEDICLPRWGCLWE, H115S126delinsIEDICLPRWGCLWE, T128P134delinsIEDICLPRWGCLWE, S103S111delinsDICLPRWGCLWED, H115S126delinsDICLPRWGCLWED, T128P134delinsDICLPRWGCLWED, P406insIEDICLPRWGCLW, P406insGGGSIEDICLPRWGCLW, P406insDICLPRWGCLWED and P406insGGGSDICLPRWGCLWED Provided herein are modified FVII polypeptides containing a platelet integrin $\alpha_{IIb}\beta_3$ binding sequence. Such modified FVII polypeptides can exhibit increased affinity for or binding to platelet integrin $\alpha_{IIb}\beta_3$ compared with the unmodified FVII polypeptide. For example, modified FVII polypeptides containing a platelet integrin $\alpha_{IIb}\beta_3$ binding sequence can exhibit at least about or 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more increased affinity for or binding to platelet integrin $\alpha_{IIb}\beta_3$ binding compared to the unmodified FVII polypeptide. Examples of serum albumin binding sequence include those sequence of amino acids set forth in any of SEQ ID NOS: 110-112, or a sufficient portion thereof to effect platelet integrin $\alpha_{IIb}\beta_3$ binding, which can replace a contiguous sequence of amino acid residues of the unmodified FVII polypeptide. Modified FVII polypeptides containing a modification selected from among S103S111delinsSFGRGDIRNV, H115S126delinsSFGRGDIRNV, T127P134delinsSFGRGDIRNV, P406insCSFGRGDIRNVC and P406insGGGSCSFGRGDIRNVC.

The modified FVII polypeptides containing a serum albumin or platelet integrin $\alpha_{IIb}\beta_3$ binding sequence also can contain one or more further modifications at another position in the FVII polypeptide, such as amino acid replacement at a position corresponding to a position G237V. Thus also provided herein are modified FVII polypeptides containing a modification selected from among S103S111delinsIEDICLPRWGCLWE/G237V, S103S111delinsDICLPRWGCLWED/G237V, H115S126delinsQRLMEDICLPRWGCLWEDDF/G237V, H115S126delinsIEDICLPRWGCLWE/G237V, H115S126delinsDICLPRWGCLWED/G237V, T128P34delinsQRLMEDICLPRWGCLWEDDF/G237V, T128P134delinsIEDICLPRWGCLWE/G237V, S103S111delinsQRLMEDICLPRWGCLWEDDF/G237V and T128P134delinsDICLPRWGCLWED/G237V In some examples, the modified FVII polypeptides provided herein contain 2, 3, 4, 5, 6, 7 or more modifications. In further examples, the modified FVII polypeptides provided herein contain a heterologous Gla domain, or a sufficient portion thereof to effect phospholipid binding. Such polypeptides can exhibit increased affinity for or binding to phospholipids compared with the unmodified FVII polypeptide, such as at least about or 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more increased affinity for or binding to phospholipids. The heterologous Gla domain can be selected from among a Gla domain in Factor IX (FIX), Factor X (FX), prothrombin, protein C, protein S, osteocalcin, matrix Gla protein, Growth-arrest-specific protein 6 (Gas6) and protein Z and, in some examples, can have a sequence of amino acids set forth in any of SEQ ID NOS: 83-91, 93 and 94, or a sufficient portion thereof to effect phospholipid binding. All or a contiguous portion of the native FVII Gla domain, which can include amino acids 1-45 in a FVII polypeptide having a sequence of amino acids set forth in SEQ ID NO:3, or in corresponding residues in a FVII polypeptide, can removed and replaced with the heterologous Gla domain, or a sufficient portion thereof to effect phospholipid binding.

Modified FVII polypeptides provided herein can exhibit increased resistance to antithrombin III compared with the unmodified FVII polypeptide. Such a modified FVII polypeptide can exhibit at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more resistance to antithrombin III compared to the unmodified FVII polypeptide. The modified FVII polypeptides provided herein also can exhibit increased catalytic or coagulant activity compared with the unmodified FVII polypeptide, such as an increase of least about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more compared to an unmodified FVII polypeptide. Further, the modified FVII polypeptides provided herein can exhibit increased resistance to TFPI compared with the unmodified FVII polypeptide. Such modified FVII polypeptides can be at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more resistant to TFPI compared to an unmodified FVII polypeptide. Modified FVII polypeptides provided herein also can exhibit increased resistance to the inhibitory effects of $Zn^{2+}$ compared with the unmodified FVII polypeptide. For example, a modified FVII polypeptide can be at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more resistant to the inhibitory effects of Zn2+ compared to an unmodified FVII polypeptide.

In some examples, the modified FVII polypeptides provided herein contain one or more modifications that introduce and/or eliminate one or more glycosylation sites compared to the unmodified FVII polypeptide. For example, 1, 2, 3, 4, 5, 6, or more glycosylation sites can be introduced or eliminated. Glycosylation sites that can be introduced or eliminated include N-glycosylation sites and O-glycosylation sites. The modified FVII polypeptides provided herein can contain one or more further amino acid modification(s) that increases resistance to antithrombin-III, increases binding and/or affinity to phospholipids, increases affinity for tissue factor, increases intrinsic activity, increases TF-dependent activity, increases coagulant activity, alters the conformation of the polypeptide to alter zymogenicity, increases catalytic or coagulant activity by shifting the equilibrium between highly active and less active FVIIa conformations in favor of the highly active conformations, increases resistance to proteases, decreases glycosylation, increases glycosylation, reduces immunogenicity, increases stability, and/or facilitates chemical group linkage. In some examples, the altered zymogenicity confers a more zymogen-like shape or a less zymogen-like shape.

In some examples, the modified FVII polypeptides provided herein contain one or more further amino acid modification(s) selected from among S279C/V302C, L280C/N301C, V281C/V302C, S282C/V299C, insertion of a tyrosine at position 4, F4S, F4T, P10Q, P10E, P10D, P10N, Q21N, R28F, R28E, I30C, I30D, I30E, K32D, K32Q, K32E, K32G, K32H, K32T, K32C, K32A, K32S, D33C, D33F, D33E, D33K, A34C, A34E, A34D, A34I, A34L, A34M, A34V, A34F, A34W, A34Y, R36D, R36E, T37C, T37D, T37E, K38C, K38E, K38T, K38D, K38L, K38G, K38A, K38S, K38N, K38H, L39E, L39Q, L39H, W41N, W41C, W41E, W41D, I42R, I42N, I42S, I42A, I42Q, I42N, I42S, I42A, I42Q, I42K, S43Q, S43N, Y44K, Y44C, Y44D, Y44E, S45C, S45D, S45E, D46C, A51N, S53N, G58N, G59S, G59T, K62E, K62R, K62D, K62N, K62Q, K62T, L65Q, L65S, L65N, F71D, F71Y, F71E, F71Q, F71N, P74S, P74A, A75E, A75D, E77A, E82Q, E82N, E82S, E82T T83K, N95S, N95T, G97S, G97T, Y101N, D104N, T106N, K109N, E116D, G117N, G124N, S126N, T128N, L141C, L141D, L141E, E142D, E142C, K143C, K143D, K143E, R144E, R144C, R144D, N145Y, N145G, N145F, N145M, N145S, N145I, N145L, N145T, N145V, N145P, N145K, N145H, N145Q, N145E, N145R, N145W, N145D, N145C, K157V, K157L, K157I, K157M, K157F, K157W, K157P, K157G, K157S, K157T, K157C, K157Y, K157N, K157E, K157R, K157H, K157D, K157Q, V158L, V158I, V158M, V158F, V158W, V158P, V158G, V158S, V158T, V158C, V158Y, V158N, V158E, V158R, V158K, V158H, V158D, V158Q, A175S, A175T, G179N, I186S, I186T, V188N, R202S, R202T, I205S, I205T, D212N, E220N, I230N, P231N, P236N, G237N, Q250C, V253N, E265N, T267N, E270N, A274M, A274L, A274K, A274R, A274D, A274V, A274I, A274F, A274W, A274P, A274G, A274T, A274C, A274Y, A274N, A274E, A274H, A274S, A274Q, F275H, R277N, F278S, F278A, F278N, F278Q, F278G, L280N, L288K, L288C, L288D, D289C, D289K, L288E, R290C, R290G, R290A, R290S, R290T, R290K, R290D, R290E, G291E, G291D, G291C, G291N, G291K, A292C, A292K, A292D, A292E, T293K, E296V, E296L, E296I, E296M, E296F, E296W, E296P, E296G, E296S, E296T, E296C, E296Y, E296N, E296K, E296R, E296H, E296D, E296Q, M298Q, M298V, M298L, M298I, M298F, M298W, M298P, M298G, M298S, M298T, M298C, M298Y, M298N, M298K, M298R, M298H, M298E, M298D, P303S, P303T, R304Y, R304F, R304L, R304M, R304G, R304T, R304A, R304S, R304N, L305V, L305Y, L305I, L305F, L305A, L305M, L305W, L305P, L305G, L305S, L305T, L305C, L305N, L305E, L305K, L305R, L305H, L305D, L305Q, M306D, M306N, D309S, D309T, Q312N, Q313K, Q313D, Q313E, S314A, S314V, S314I, S314M, S314F, S314W, S314P, S314G, S314L, S314T, S314C, S314Y, S314N, S314E, S314K, S314R, S314H, S314D, S314Q, R315K, R315G, R315A, R315S, R315T, R315Q, R315C, R315D, R315E, K316D, K316C, K316E, V317C, V317K, V317D, V317E, G318N, N322Y, N322G, N322F, N322M, N322S, N322I, N322L, N322T, N322V, N322P, N322K, N322H, N322Q, N322E, N322R, N322W, N322C, G331N, Y332S, Y332A, Y332N, Y332Q, Y332G, D334G, D334E, D334A, D334V, D334I, D334M, D334F, D334W, D334P, D334L, D334T, D334C, D334Y, D334N, D334K, D334R, D334H, D334S, D334Q, S336G, S336E, S336A, S336V, S336I, S336M, S336F, S336W, S336P, S336L, S336T, S336C, S336Y, S336N, S336K, S336R, S336H, S336D, S336Q, K337L, K337V, K337I, K337M, K337F, K337W, K337P, K337G, K337S, K337T, K337C, K337Y, K337N, K337E, K337R, K337H, K337D, K337Q, K341E, K341Q, K341G, K341T, K341A, K341S, G342N, H348N, R353N, Y357N, I361N, F374P, F374A, F374V, F374I, F374L, F374M, F374W, F374G, F374S, F374T, F374C, F374Y, F374N, F374E, F374K, F374R, F374H, F374D, F374Q, V376N, R379N, L390C, L390K, L390D, L390E, M391D, M391C, M391K, M391N, M391E, R392C, R392D, R392E, S393D, S393C, S393K, S393E, E394K, P395K, E394C, P395D, P395C, P395E, R396K, R396C, R396D, R396E, P397D, P397K, P397C, P397E, G398K, G398C, G398D, G398E, V399C, V399D, V399K, V399E, L400K, L401K, L401C, L401D, L401E, R402D, R402C, R402K, R402E, A403K, A403C, A403D, A403E, P404E, P404D, P404C, P404K, F405K, P406C, K32N/A34S, K32N/A34T, F31N/D33S, F31N/D33T, I30N/K32S, I30N/K32T, A34N/R36S, A34N/R36T, K38N/F40S, K38N/F40T, T37N/L39S, T37N/L39T, R36N/K38S, R36N/K38T, L39N/W41S, L39N/W41T, F40N/I42S, F40N/I42T, I42N/Y44S, I42N/Y44T, Y44N/D46S, Y44N/D46T, D46N/D48S, D46N/D48T, G47N/Q49S, G47N/Q49T, K143N/N145S, K143N/N145T, E142N/R144S, E142N/R144T, L141N/K143S, L141N/K143T, I140N/E142S, I140N/E142T, R144N/A146S, R144N/A146T, A146N/K148S, A146N/K148T, S147N/P149S/, S147N/P149T, R290N/A292S, R290N/A292T, D289N/G291S, D289N/G291T, L288N/R290S, L288N/R290T, L287N/D289S, L287N/D289T, A292N/A294S, A292N/A294T, T293N/L295S, T293N/L295T, R315N/V317S, R315N/V317T, S314N/K316S, S314N/K316T, Q313N/R315S, Q313N/R315T, K316N/G318S, K316N/G318T, V317N/D319S, V317N/D319T, K341N/D343S, K341N/D343T, S339N/K341S, S339N/K341T, D343N/G345S, D343N/G345T, R392N/E394S, R392N/E394T, L390N/R392S, L390N/R392T, K389N/M391S, K389N/M391T, S393N/P395S, S393N/P395T, E394N/R396S, E394N/R396T, P395N/P397S, P395N/P397T, R396N/G398S, R396N/G398T, P397N/V399S, P397N/V399T, G398N/L400S, G398N/L400T, V399N/L401S, V399N/L401T, L400N/R402S, L400N/R402T, L401N/A403S, L401N/A403T, R402N/P404S, R402N/P404T, A403N/F405S, A403N/F405T, P404N/P406S and P404N/P406T. In some examples, the modified FVII polypeptides also contain a substitution of positions 300-322, 305-322, 300-312, or 305-312 with the corresponding amino acids from trypsin, thrombin or FX, or substitution of positions 310-329, 311-322 or 233-329 with the corresponding amino acids from trypsin.

Exemplary of modified FVII polypeptides provided herein are those having a sequence of amino acids set forth in any of SEQ ID NOS: 113-273. In some examples, the modifications are made in an unmodified FVII polypeptide that is an allelic or species variant of the polypeptide set forth in SEQ ID NO:3. The allelic or species or other variant can have 40%, 50%, 60%, 70%, 80%, 90%, 91%, 92%, 93%, 94%, 95%, 96%, 97%, 98%, or 99% sequence identity to the polypeptide set forth in SEQ ID NO:3, excluding the amino acid modification(s). The modified FVII polypeptide provided herein can be a human polypeptide, a non-human polypeptide and/or a mature polypeptide. In some examples, only the primary sequence is modified. In other examples, a chemical modification or a post-translational modification also is included. For example, the modified FVII polypeptide can be glycosylated, carboxylated, hydroxylated, sulfated, phosphorylated, albuminated, or conjugated to a polyethylene glycol (PEG) moiety.

The modified FVII polypeptides provided herein can be single-chain polypeptides, a two-chain polypeptides and/or active or activated. Activation can be effected by proteolytic cleavage by autoactivation, cleavage by Factor IX (FIXa), cleavage by Factor X (FXa), cleavage by Factor XII (FXIIa), or cleavage by thrombin.

The modified FVII polypeptides provided herein can retain one or more activities of the unmodified FVII polypeptide. For example, the modified FVII polypeptides can contain modifications at 1, 2, 3, 4, 5, 6, 7, 8, 9, 10, 20, 30, 40, 50 or 60 amino acid positions so long as the polypeptide retains at least one FVII activity of the unmodified FVII polypeptide. Such modified FVII polypeptides can retain at least about 1%, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more of an activity of the unmodified FVII polypeptide. In some examples, one or more activities are selected from among tissue factor (TF) binding, factor X (FX) activation, Factor IX (FIX) activation, phospholipid binding, and coagulation activity. Further, the activities that are retained can increased or decreased compared to the unmodified FVII polypeptide. In some examples, the coagulation activity is increased compared to the unmodified FVII polypeptide, such as at least about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the coagulation activity of the unmodified FVII polypeptide. Activities can measured in vitro, ex vivo or in vivo.

Provided herein are nucleic acid molecules containing a sequence of nucleotides encoding modified FVII polypeptides provided herein. Also provided are vectors containing such nucleic acid molecules, including prokaryotic vectors, viral vectors, or a eukaryotic vectors, such as a mammalian vector. Viral vectors can selected from among an adenovirus, an adeno-associated-virus, a retrovirus, a herpes virus, a lentivirus, a poxvirus, and a cytomegalovirus. Provided herein are cells containing these vectors, including eukaryotic cells, such as mammalian cells. Exemplary of mammalian cells are baby hamster kidney cells (BHK-21) or 293 cells or CHO cells. In some examples, the cells express the modified FVII polypeptide. Thus, also provided herein are modified FVII polypeptides that are produced by these cells.

Provided herein are pharmaceutical compositions containing a therapeutically effective concentration or amount of any modified FVII polypeptide, nucleic acid molecule, vector or cell provided herein in a pharmaceutically acceptable vehicle.

In some examples, the pharmaceutical composition is formulated for local, systemic, or topical administration, such as oral, nasal, pulmonary buccal, transdermal, subcutaneous, intraduodenal, enteral, parenteral, intravenous, or intramuscular administration. The pharmaceutical compositions also can be formulated for controlled-release and/or single-dosage administration.

Provided herein are methods of treating a subject by administering a pharmaceutical composition provided herein, wherein the subject has a disease or condition that is treated by administration of FVII or a procoagulant, such as by administration of active FVII (FVIIa). In some examples, treatment with the pharmaceutical composition ameliorates or alleviates the symptoms associated with the disease or condition. In further examples, the methods provided herein also include monitoring the subject for changes in the symptoms associated with disease or condition that is treated by administration of FVII or a procoagulant. The disease or condition to be treated using the methods provided herein can be selected from among blood coagulation disorders, hematologic disorders, hemorrhagic disorders, hemophilia (such as is hemophilia A or hemophilia B or hemophilia C, congenital or acquired hemophilia), factor VII deficiency and bleeding disorders, including bleeding complication due to surgery (such as heart surgery, angioplasty, lung surgery, abdominal surgery, spinal surgery, brain surgery, vascular surgery, dental surgery, or organ transplant surgery) or trauma. In some examples, the bleeding is manifested as acute haemarthroses, chronic haemophilic arthropathy, haematomas, haematuria, central nervous system bleedings, gastrointestinal bleedings, or cerebral haemorrhage. In further examples, the bleeding is due to dental extraction. The transplant surgery can be selected from among transplantation of bone marrow, heart, lung, pancreas, and liver.

In some examples, the method provided herein can be used to treat a subject that has autoantibodies to factor VIII or factor IX. The methods provided herein also can included administering one or more additional coagulation factors, such as plasma purified or recombinant coagulation factors, procoagulants, such as vitamin K, vitamin K derivative and protein C inhibitors, plasma, platelets, red blood cells and corticosteroids, or treatments.

Provided herein are articles of manufacture containing packaging material and a pharmaceutical composition provided herein contained within the packaging material. In some examples, the modified FVII polypeptide in the pharmaceutical composition is effective for treatment of a FVII-mediated disease or disorder, and the packaging material includes a label that indicates that the modified FVII polypeptide is used for treatment of a FVII-mediated disease or disorder. Also provided herein are kits, comprising a pharmaceutical composition described herein, a device for administration of the composition and, optionally, instructions for administration.

BRIEF DESCRIPTION OF THE FIGURES

FIG. 1 depicts the coagulation cascade. The figure shows the intrinsic pathway and the extrinsic pathway of coagulation for the independent production of FXa and convergence of the pathways to a common pathway to generate thrombin and fibrin for the formation of a clot. These pathways are interconnected. The figure depicts the order of molecules involved in the activation cascade in which a zymogen is converted to an activated protease by cleavage of one or more peptide bonds. The activated protease then serves as the activating protease for the next zymogen molecule in the cascade, ultimately resulting in clot formation.

FIG. 2 depicts the cell based model of coagulation (see e.g. Hoffman et al. (2001) Thromb Haemost 85:958-965). The figure depicts the coagulation events as being separated into three phases, where initiation of coagulation is effected by the activation of FX to FXa by the TF/FVIIa complex on the TF-bearing cell, resulting in the generation of a small amount of thrombin after activation by FXa/FVa. Amplification takes place when thrombin binds to and activates the platelets, and initiates the activation of sufficient quantities of the appropriate coagulation factors to form the FVIIIa/FIXa and FVa/FXa complexes. Propagation of coagulation occurs on the surface of large numbers of activated platelets at the site of injury, resulting in a burst of thrombin generation that is sufficiently large to generate enough fibrin from fibrinogen to establish a clot at the site of injury.

FIG. 3 depicts the mechanisms by which FVIIa can initiate thrombin formation. The figure illustrates the TF-dependent pathway of FVIIa thrombin generation, which acts at the surface of a TF-bearing cell and involves complexing of FVIIa with TF prior to activation of FX to FXa. The figure also depicts the TF-independent pathway of FVIIa thrombin generation, during which FVIIa binds to phospholipids on the activated platelet and activates FX to FXa, which in turn complexes with FVa to cleave prothrombin into thrombin.

DETAILED DESCRIPTION

| Outline |
|---|
| A. Definitions |
| B. Hemostasis Overview |
|     1. Platelet adhesion and aggregation |
|     2. Coagulation cascade |
|         a. Initiation |
|         b. Amplification |
|         c. Propagation |
|     3. Regulation of Coagulation |
| C. Factor VII (FVII) |
|     1. FVII structure and organization |
|     2. Post-translational modifications |
|     3. FVII processing |
|     4. FVII activation |
|     5. FVII function |
|         a. Tissue factor-dependent FVIIa activity |
|         b. Tissue factor-independent FVIIa activity |
|     6. FVII as a biopharmaceutical |
| D. Modified FVII polypeptides |
|     1. Increased catalytic activity |
|         a. Exemplary modifications to increase catalytic activity |
|             i. Basic amino acid substitutions at position 286 |
|             ii. Other mutations at position 286 |
|     2. Increased resistance to AT-III |
|         Exemplary modifications to effect increased resistance to AT-III |
|     3. Increased resistance to inhibition by $Zn^{2+}$ |
|         Exemplary modifications to increase resistance to inhibition by $Zn^{2+}$ |
|     4. Altered glycosylation |
|         Exemplary modifications to alter glycosylation |
|     5. Increased binding to serum albumin and/or platelet integrin $\alpha_{IIb}\beta_3$ |
|         a. Exemplary FVII polypeptides with serum albumin binding sequences |
|         b. Exemplary FVII polypeptides with platelet integrin $\alpha_{IIb}\beta_3$ binding sequences |
|     6. Modification by introduction of a heterologous Gla domain |
|     7. Combinations and Additional Modifications |
|         a. Modifications that increase resistance to TFPI |
|         b. Modifications that increase intrinsic activity |

-continued

Outline c. Modifications that increase resistance to proteases
   d. Modifications that increase affinity for phospholipids
   e. Modifications that alter glycosylation
   f. Modifications to facilitate chemical group linkage
   g. Exemplary combination mutations
 E. Production of FVII polypeptides
  1. Vectors and cells
  2. Expression systems
   a. Prokaryotic expression
   b. Yeast
   c. Insects and insect cells
   d. Mammalian cells
   e. Plants
  2. Purification
  3. Fusion proteins
  4. Polypeptide modifications
  5. Nucleotide sequences
 F. Assessing modified FVII polypeptide activities
  1. In vitro assays
   a. Post-translational modification
   b. Proteolytic activity
   c. Coagulation activity
   d. Binding to and/or inhibition by other proteins
   e. Phospholipid binding
  2. Non-human animal models
  3. Clinical assays
 G. Formulation and administration
  1. Formulations
   a. Dosages
   b. Dosage forms
  2. Administration of modified FVII polypeptides
  3. Administration of nucleic acids encoding modified FVII polypeptides (gene therapy)
 H. Therapeutic Uses
  1. Congenital bleeding disorders
   a. Hemophilia
   b. FVII deficiency
   c. Others
  2. Acquired bleeding disorders
   a. Chemotherapy-acquired thrombocytopenia
   b. Other coagulopathies
   c. Transplant-acquired bleeding
   d. Anticoagulant therapy-induced bleeding
   e. Acquired hemophilia
  3. Trauma and surgical bleeding
 I. Combination Therapies
 J. Articles of manufacture and kits
 K. Examples

A. Definitions

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, coagulation pathway or coagulation cascade refers to the series of activation events that leads to the formation of an insoluble fibrin clot. In the coagulation cascade or pathway, an inactive protein of a serine protease (also called a zymogen) is converted to an active protease by cleavage of one or more peptide bonds, which then serves as the activating protease for the next zymogen molecule in the cascade. In the final proteolytic step of the cascade, fibrinogen is proteolytically cleaved by thrombin to fibrin, which is then crosslinked at the site of injury to form a clot.

As used herein, "hemostasis" refers to the stopping of bleeding or blood flow in an organ or body part. The term hemostasis can encompass the entire process of blood clotting to prevent blood loss following blood vessel injury to subsequent dissolution of the blood clot following tissue repair.

As used herein, "clotting" or "coagulation" refers to the formation of an insoluble fibrin clot, or the process by which the coagulation factors of the blood interact in the coagulation cascade, ultimately resulting in the formation of an insoluble fibrin clot.

As used herein, a "protease" is an enzyme that catalyzes the hydrolysis of covalent peptidic bonds. These designations include zymogen forms and activated single-, two- and multiple-chain forms thereof. For clarity, reference to proteases refer to all forms. Proteases include, for example, serine proteases, cysteine proteases, aspartic proteases, threonine and metallo-proteases depending on the catalytic activity of their active site and mechanism of cleaving peptide bonds of a target substrate.

As used herein, serine proteases or serine endopeptidases refers to a class of peptidases, which are characterized by the presence of a serine residue in the active site of the enzyme. Serine proteases participate in a wide range of functions in the body, including blood clotting and inflammation, as well as functioning as digestive enzymes in prokaryotes and eukaryotes. The mechanism of cleavage by serine proteases is based on nucleophilic attack of a targeted peptidic bond by a serine. Cysteine, threonine or water molecules associated with aspartate or metals also can play this role. Aligned side chains of serine, histidine and aspartate form a catalytic triad common to most serine proteases. The active site of serine proteases is shaped as a cleft where the polypeptide substrate binds.

As used herein, Factor VII (FVII, F7; also referred to as Factor 7, coagulation factor VII, serum factor VII, serum prothrombin conversion accelerator, SPCA, proconvertin and eptacog alpha) refers to a serine protease that is part of the coagulation cascade. FVII includes a Gla domain, two EGF domains (EGF-1 and EGF-2), and a serine protease domain (or peptidase S1 domain) that is highly conserved among all members of the peptidase S1 family of serine proteases, such as for example with chymotrypsin. The sequence of an exemplary precursor FVII having a signal peptide and propeptide is set forth in SEQ ID NO:1. An exemplary mature FVII polypeptide is set forth in SEQ ID NO:3. FVII occurs as a single chain zymogen, a zymogen-like two-chain polypeptide and a fully activated two-chain form. Full activation, which occurs upon conformational change from a zymogen-like form, occurs upon binding to is co-factor tissue factor. Also, mutations can be introduced that result in the conformation change in the absence of tissue factor. Hence, reference to FVII includes single-chain and two-chain forms thereof, including zymogen-like and fully activated two-chain forms.

Reference to FVII polypeptide also includes precursor polypeptides and mature FVII polypeptides in single-chain or two-chain forms, truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptide set forth in SEQ ID NO:1 or the mature form thereof. Included are modified FVII polypeptides, such as those of SEQ ID NOS: 113 and 273 and variants thereof. Also included are those that retain at least an activity of a FVII, such as TF binding, factor X binding, phospholipid binding, and/or coagulant activity of a FVII. By retaining activity, the activity can be altered, such as reduced or increased, as compared to a wild-type FVII so long as the level of activity retained is sufficient to yield a detectable effect. FVII polypeptides include, but are not limited to, tissue-specific isoforms and allelic variants thereof, synthetic molecules prepared by translation of nucleic acids, proteins generated by chemical synthesis, such as syntheses that include ligation of shorter polypeptides, through recombinant methods, proteins isolated from human and non-human tissue and cells, chimeric FVII polypeptides and modified forms thereof. FVII polypeptides also include fragments or portions of FVII that are of sufficient length or include appropriate regions to retain at least one activity (upon activation if needed) of a full-length mature polypeptide. FVII polypeptides also include those that contain chemical or posttranslational modifications and those that do not contain chemical or posttranslational modifications. Such modifications include, but are not limited to, pegylation, albumination, glycosylation, farnysylation, carboxylation, hydroxylation, phosphorylation, and other polypeptide modifications known in the art.

Exemplary FVII polypeptides are those of mammalian, including human, origin. Exemplary amino acid sequences of FVII of human origin are set forth in SEQ ID NOS: 1, 2, and 3. Exemplary variants of such a human FVII polypeptide, include any of the precursor polypeptides set forth in SEQ ID NOS: 18-74. FVII polypeptides also include any of non-human origin including, but not limited to, murine, canine, feline, leporine, avian, bovine, ovine, porcine, equine, piscine, ranine, and other primate factor VII polypeptides. Exemplary FVII polypeptides of non-human origin include, for example, cow (*Bos taurus*, SEQ ID NO:4), mouse (*Mus musculus*, SEQ ID NO:5), pygmy chimpanzee (*Pan paniscus*, SEQ ID NO:6), chimpanzee (Pan troglodytes, SEQ ID NO:7), rabbit (*Oryctolagus cuniculus*, SEQ ID NO:8), rat (*Rattus norvegicus*, SEQ ID NO:9), rhesus macaque (*Macaca mulatta*, SEQ ID NO:10), pig (*Sus scrofa*, SEQ ID NO:11), dog (*Canis familiaris*, SEQ ID NO:12), zebrafish (*Brachydanio rerio*, SEQ ID NO:13), Japanese pufferfish (*Fugu rubripes*, SEQ ID NO:14), chicken (*Gallus gallus*, SEQ ID NO:15), orangutan (*Pongo pygmaeus*, SEQ ID NO:16) and gorilla (*Gorilla gorilla*, SEQ ID NO:17).

One of skill in the art recognizes that the referenced positions of the mature factor VII polypeptide (SEQ ID NO:3) differ by 60 amino acid residues when compared to the isoform a precursor FVII polypeptide set forth in SEQ ID NO:1, which is the isoform a factor VII polypeptide containing the signal peptide and propeptide sequences. Thus, the first amino acid residue of SEQ ID NO:3 "corresponds to" the sixty first (61st) amino acid residue of SEQ ID NO:1. One of skill in the art also recognizes that the referenced positions of the mature factor VII polypeptide (SEQ ID NO:3) differ by 38 amino acid residues when compared to the precursor FVII polypeptide set forth in SEQ ID NO:2, which is the isoform b factor VII polypeptide containing the signal peptide and propeptide sequences. Thus, the first amino acid residue of SEQ ID NO:3 "corresponds to" the thirty-ninth (39$^{th}$) amino acid residue of SEQ ID NO:2.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of polypeptides, one skilled in the art can identify corresponding residues, using conserved and identical amino acid residues as guides. For example, by aligning the sequences of factor VII polypeptides, one of skill in the art can identify corresponding residues, using conserved and identical amino acid residues as guides. For example, the alanine in amino acid position 1 (A1) of SEQ ID NO:3 (mature factor VII) corresponds to the alanine in amino acid position 61 (A61) of SEQ ID NO:1, and the alanine in amino acid position 39 (A39) of SEQ ID NO:2. In other instances, corresponding regions can be identified. For example, the Gla domain corresponds to amino acid positions A1 through F45 of SEQ ID NO:3, to amino acid positions A61 through S105 of SEQ ID NO:1 and to amino acid positions A39 to S83 of SEQ ID NO:2. One skilled in the art also can employ conserved amino acid residues as guides to find corresponding amino acid residues between and among human and non-human sequences. For example, amino acid residues S43 and E163 of SEQ ID NO:3 (human) correspond to S83 and E203 of SEQ ID NO:4 (bovine). Corresponding positions also can be based on structural alignments, for example by using computer simulated alignments of protein structure. In other instances, corresponding regions can be identified.

As used herein, a "proregion," "propeptide," or "pro sequence," refers to a region or a segment that is cleaved to produce a mature protein. This can include segments that function to suppress proteolytic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, "mature factor VII" refers to a FVII polypeptide that lacks a signal sequence and a propeptide sequence. Typically, a signal sequence targets a protein for secretion via the endoplasmic reticulum (ER)-golgi pathway and is cleaved following insertion into the ER during translation. A propeptide sequence typically functions in post-translational modification of the protein and is cleaved prior to secretion of the protein from the cell. Thus, a mature FVII polypeptide is typically a secreted protein. In one example, a mature human FVII polypeptide is set forth in SEQ ID NO:3. The amino acid sequence set forth in SEQ ID NO:3 differs from that of the precursor polypeptides set forth in SEQ ID NOS:1 and 2 in that SEQ ID NO:3 is lacking the signal sequence, which corresponds to amino acid residues 1-20 of SEQ ID NOS:1 and 2; and also lacks the propeptide sequence, which corresponds to amino acid residues 21-60 of SEQ ID NO:1 and amino acid residues 21-38 of SEQ ID NO:2. Reference to a mature FVII polypeptide encompasses the single-chain zymogen form and the two-chain form.

As used herein, "wild-type" or "native" with reference to FVII refers to a FVII polypeptide encoded by a native or naturally occurring FVII gene, including allelic variants, that is present in an organism, including a human and other animals, in nature. Reference to wild-type factor VII without reference to a species is intended to encompass any species of a wild-type factor VII. Included among wild-type FVII polypeptides are the encoded precursor polypeptide, fragments thereof, and processed forms thereof, such as a mature form lacking the signal peptide as well as any pre- or post-translationally processed or modified forms thereof. Also included among native FVII polypeptides are those that are post-translationally modified, including, but not limited to, modification by glycosylation, carboxylation and hydroxylation. Native FVII polypeptides also include single-chain and two-chain forms. For example, humans express native FVII. The amino acid sequence of exemplary wild-type human FVII are set forth in SEQ ID NOS:1, 2, 3 and allelic variants set forth in SEQ ID NOS:44-100 and the mature forms thereof. Other animals produce native FVII, including, but not limited to, cow (*Bos Taurus*, SEQ ID NO:4), mouse (*Mus musculus*, SEQ ID NO:5), pygmy chimpanzee (*Pan paniscus*, SEQ ID NO:6), chimpanzee (*Pan troglodytes*, SEQ ID NO:7), rabbit (*Oryctolagus cuniculus*, SEQ ID NO:8), rat (*Rattus norvegicus*, SEQ ID NO:9), rhesus macaque (*Macaca mulatta*, SEQ ID NO:10), pig (*Sus scrofa*, SEQ ID NO:11), dog (*Canis familiaris*, SEQ ID NO:12), zebrafish (*Brachydanio rerio*, SEQ ID NO:13) Japanese pufferfish (*Fugu rubripes*, SEQ ID NO:14), chicken (*Gallus gallus*, SEQ ID NO:15), orangutan (*Pongo pygmaeus*, SEQ ID NO:16) and gorilla (*Gorilla gorilla*, SEQ ID NO:17).

As used herein, species variants refer to variants in polypeptides among different species, including different mammalian species, such as mouse and human.

As used herein, allelic variants refer to variations in proteins among members of the same species.

As used herein, a splice variant refers to a variant produced by differential processing of a primary transcript of genomic DNA that results in more than one type of mRNA.

As used herein, a zymogen refers to a protease that is activated by proteolytic cleavage, including maturation cleavage, such as activation cleavage, and/or complex formation with other protein(s) and/or cofactor(s). A zymogen is an inactive precursor of a proteolytic enzyme. Such precursors are generally larger, although not necessarily larger, than the active form. With reference to serine proteases, zymogens are converted to active enzymes by specific cleavage, including catalytic and autocatalytic cleavage, or by binding of an activating co-factor, which generates an active enzyme. For example, generally, zymogens are present in a single-chain form. Zymogens, generally, are inactive and can be converted to mature active polypeptides by catalytic or autocatalytic cleavage at one or more proteolytic sites to generate a multi-chain, such as a two-chain, polypeptide. A zymogen, thus, is an enzymatically inactive protein that is converted to a proteolytic enzyme by the action of an activator. Cleavage can be effected by autoactivation. A number of coagulation proteins are zymogens; they are inactive, but become cleaved and activated upon the initiation of the coagulation system following vascular damage. With reference to FVII, the FVII polypeptides exist in the blood plasma as zymogens until cleavage by aproteases, such as for example, activated factor IX (FIXa), activated factor X (FXa), activated factor XII (FXIIa), thrombin, or by autoactivation to produce a zymogen-like two-chain form, which then requires further conformation change for full activity.

As used herein, a "zymogen-like" protein or polypeptide refers to a protein that has been activated by proteolytic cleavage, but still exhibits properties that are associated with a zymogen, such as, for example, low or no activity, or a conformation that resembles the conformation of the zymogen form of the protein. For example, when it is not bound to tissue factor, the two-chain activated form of FVII is a zymogen-like protein; it retains a conformation similar to the uncleaved FVII zymogen, and, thus, exhibits very low activity. Upon binding to tissue factor, the two-chain activated form of FVII undergoes conformational change and acquires its full activity as a coagulation factor.

As used herein, an activation sequence refers to a sequence of amino acids in a zymogen that is the site required for activation cleavage or maturation cleavage to form an active protease. Cleavage of an activation sequence can be catalyzed autocatalytically or by activating partners.

As used herein, activation cleavage is a type of maturation cleavage, which induces a conformation change that is required for the development of full enzymatic activity. This is a classical activation pathway, for example, for serine proteases in which a cleavage generates a new N-terminus that interacts with the conserved regions of the protease, such as Asp 194 in chymotrypsin, to induce conformational changes required for activity. Activation can result in production of multi-chain forms of the proteases. In some instances, single chain forms of the protease can exhibit proteolytic activity.

As used herein, "activated Factor VII" or "FVIIa" refers to any two-chain form of a FVII polypeptide. A two-chain form typically results from proteolytic cleavage, but can be produced synthetically. Activated Factor VII, thus, includes the zymogen-like two-chain form with low coagulant activity, a fully activated form (about 1000-fold more activity) that occurs upon binding to tissue factor, and mutated forms that exist in a fully activated two-chain form or undergo conformation change to a fully activated form. For example, a single-chain form of FVII polypeptide (see, e.g., SEQ ID NO:3) is proteolytically cleaved between amino acid residues R152 and I153 of the mature FVII polypeptide. The cleavage products, FVII heavy chain and FVII light chain, which are held together by a disulfide bond (between amino acid residues C135 and C262 in the FVII of SEQ ID NO:3), form the two-chain activated FVII enzyme. Proteolytic cleavage can be carried out, for example, by activated factor IX (FIXa), activated factor X (FXa), activated factor XII (FXIIa), thrombin, or by autoactivation.

As used herein, a "property" of a FVII polypeptide refers to a physical or structural property, such three-dimensional structure, pI, half-life, conformation and other such physical characteristics.

As used herein, an "activity" of a FVII polypeptide refers to any activity exhibited by a factor VII polypeptide. Such activities can be tested in vitro and/or in vivo and include, but are not limited to, coagulation or coagulant activity, procoagulant activity, proteolytic or catalytic activity such as to effect factor X (FX) activation or Factor IX (FIX) activation; antigenicity (ability to bind to or compete with a polypeptide for binding to an anti-FVII antibody); ability to bind tissue factor, factor X or factor IX; and/or ability to bind to phospholipids. Activity can be assessed in vitro or in vivo using recognized assays, for example, by measuring coagulation in vitro or in vivo. The results of such assays indicate that a polypeptide exhibits an activity that can be correlated to activity of the polypeptide in vivo, in which in vivo activity can be referred to as biological activity. Assays to determine functionality or activity of modified forms of FVII are known to those of skill in the art. Exemplary assays to assess the activity of a FVII polypeptide include prothromboplastin time (PT) assay or the activated partial thromboplastin time (aPTT) assay to assess coagulant activity, or chromogenic assays using synthetic substrates, such as described in the Examples, below, to assess catalytic or proteolytic activity.

As used herein, "exhibits at least one activity" or "retains at least one activity" refers to the activity exhibited by a modified FVII polypeptide as compared to an unmodified FVII polypeptide of the same form and under the same conditions. For example, a modified FVII polypeptide in a two-chain form is compared with an unmodified FVII polypeptide in a two-chain form, under the same experimental conditions, where the only difference between the two polypeptides is the modification under study. In another example, a modified FVII polypeptide in a single-chain form is compared with an unmodified FVII polypeptide in a single-chain form, under the same experimental conditions, where the only difference between the two polypeptides is the modification under study. Typically, a modified FVII polypeptide that retains or exhibits at least one activity of an unmodified FVII polypeptide of the same form retains a sufficient amount of the activity such that, when administered in vivo, the modified FVII polypeptide is therapeutically effective as a procoagulant therapeutic. Generally, for a modified FVII polypeptide to retain therapeutic efficacy as a procoagulant, the amount of activity that is retained is or is about 0.5%, 1%, 2%, 3%, 4%, 5%, 6%, 7%, 8%, 9%, 10%, 11%, 12%, 13%, 14%, 15%, 16%, 17%, 18%, 19%, 20%, 30%, 40%, 50%, 60%, 70%, 80%, 90%, 100%, 200%, 300%, 400%, 500% or more of the activity of an unmodified FVII polypeptide of the same form that displays therapeutic efficacy as a procoagulant. The amount of activity that is required to maintain therapeutic efficacy as a procoagulant can be empirically determined, if necessary. Typically, retention of 0.5% to 20%, 0.5% to 10%, 0.5% to 5% of an activity is sufficient to retain therapeutic efficacy as a procoagulant in vivo.

It is understood that the activity being exhibited or retained by a modified FVII polypeptide can be any activity, including, but not limited to, coagulation or coagulant activity, procoagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, factor X or factor IX; and/or ability to bind to phospholipids. In some instances, a modified FVII polypeptide can retain an activity that is increased compared to an unmodified FVII polypeptide. In some cases, a modified FVII polypeptide can retain an activity that is decreased compared to an unmodified FVII polypeptide. Activity of a modified FVII polypeptide can be any level of percentage of activity of the unmodified polypeptide, where both polypeptides are in the same form, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more activity compared to the polypeptide that does not contain the modification at issue. For example, a modified FVII polypeptide can exhibit increased or decreased activity compared to the unmodified FVII polypeptide in the same form. For example, it can retain at least about or 1%, 2%, 3%, 4%, 5%, 6%, 7%, 8%, 9%, 10%, 20%, 30%, 40%, 50%, 60%, 70%, 80%, 90%, 95%, 96%, 97%, 98% or at least 99% of the activity of the unmodified FVII polypeptide. In other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified FVII. The particular level to be retained is a function of the intended use of the polypeptide and can be empirically determined. Activity can be measured, for example, using in vitro or in vivo assays such as those described herein or in the Examples below.

As used herein, "coagulation activity" or "coagulant activity" or "pro-coagulant activity" refers to the ability of a polypeptide to effect coagulation. Assays to assess coagulant activity are known to those of skill in the art, and include prothromboplastin time (PT) assay or the activated partial thromboplastin time (aPTT) assay.

As used herein, "catalytic activity" or "proteolytic activity" with reference to FVII refers to the ability of a FVII protein to catalyze the proteolytic cleavage of a substrate, and are used interchangeably. Assays to assess such activities are known in the art. For example, the proteolytic activity of FVII can be measured using chromogenic substrates such as Spectrozyme FVIIa ($CH_3SO_2$-D-CHA-But-Arg-pNA), where cleavage of the substrate is monitored by absorbance and the rate of substrate hydrolysis determined by linear regression.

As used herein, "intrinsic activity" with reference to FVII refers to the catalytic, proteolytic, and/or coagulant activity of a FVII protein in the absence of tissue factor.

As used herein, domain (typically a sequence of three or more, generally 5 or 7 or more amino acids) refers to a portion of a molecule, such as proteins or the encoding nucleic acids, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as proteolytic activity. A protein can have one, or more than one, distinct domains. For example, a domain can be identified, defined or distinguished by homology of the sequence therein to related family members, such as homology to motifs that define a protease domain or a gla domain. In another example, a domain can be distinguished by its function, such as by proteolytic activity, or an ability to interact with a biomolecule, such as DNA binding, ligand binding, and dimerization. A domain independently can exhibit a biological function or activity such that the domain independently or fused to another molecule can perform an activity, such as, for example proteolytic activity or ligand binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

As used herein, a protease domain is the catalytically active portion of a protease. Reference to a protease domain of a protease includes the single, two- and multi-chain forms of any of these proteins. A protease domain of a protein contains all of the requisite properties of that protein required for its proteolytic activity, such as for example, the catalytic center. In reference to FVII, the protease domain shares homology and structural feature with the chymotrypsin/trypsin family protease domains, including the catalytic triad. For example, in the mature FVII polypeptide set forth in SEQ ID NO:3, the protease domain corresponds to amino acid positions 153 to 392.

As used herein, a gamma-carboxyglutamate (Gla) domain refers to the portion of a protein, for example a vitamin K-dependent protein, that contains post-translational modifications of glutamate residues, generally most, but not all of the glutamate residues, by vitamin K-dependent carboxylation to form Gla. The Gla domain is responsible for the high-affinity binding of calcium ions and binding to negatively-charged phospholipids. Typically, the Gla domain starts at the N-terminal extremity of the mature form of vitamin K-dependent proteins and ends with a conserved aromatic residue. In a mature FVII polypeptide the Gla domain corresponds to amino acid positions 1 to 45 of the exemplary polypeptide set forth in SEQ ID NO:3. Gla domains are well known and their locus can be identified in particular polypeptides. The Gla domains of the various vitamin K-dependent proteins share sequence, structural and functional homology, including the clustering of N-terminal hydrophobic residues into a hydrophobic patch that mediates interaction with negatively charged phospholipids on the cell surface membrane. Exemplary other Gla-containing polypeptides include, but are not limited to, FIX, FX, prothrombin, protein C, protein S, osteocalcin, matrix Gla protein, Growth-arrest-specific protein 6 (Gas6), and protein Z. The Gla domains of these and other exemplary proteins are set forth in any of SEQ ID NOS: 83-94.

As used herein, "native" or "endogenous" with reference to a Gla domain refers to the naturally occurring Gla domain associated with all or a part of a polypeptide having a Gla domain. For purposes herein, a native Gla domain is with reference to a FVII polypeptide. For example, the native Gla domain of FVII, set forth in SEQ ID NO:92, corresponds to amino acids 1-45 of the sequence of amino acids set forth in SEQ ID NO:3.

As used herein, a heterologous Gla domain refers to the Gla domain from a polypeptide, from the same or different species, that is not a FVII Gla domain. Exemplary of heterologous Gla domains are the Gla domains from Gla-containing polypeptides including, but are not limited to, FIX, FX, prothrombin, protein C, protein S, osteocalcin, matrix Gla protein, Growth-arrest-specific protein 6 (Gas6), and protein Z. The Gla domains of these and other exemplary proteins are set forth in any of SEQ ID NOS: 83-91, 93 and 94.

As used herein, a contiguous portion of a Gla domain refers to at least two or more adjacent amino acids, typically 2, 3, 4, 5, 6, 8, 10, 15, 20, 30, 40 or more up to all amino acids that make up a Gla domain.

As used herein, "a sufficient portion of a Gla domain to effect phospholipid binding" includes at least one amino acid, typically, 2, 3, 4, 5, 6, 8, 10, 15 or more amino acids of the domain, but fewer than all of the amino acids that make up the domain so long as the polypeptide that contains such portion exhibits phospholipid binding.

As used herein, "replace" with respect to a Gla domain or "Gla domain swap" refers to the process by which the endogenous Gla domain of a protein is replaced, using recombinant, synthetic or other methods, with the Gla domain of another protein. In the context of a "Gla domain swap", a "Gla domain" is any selection of amino acids from a Gla domain and adjacent regions that is sufficient to retain phospholipid binding activity. Typically, a Gla domain swap will involve the replacement of between 40 and 50 amino acids of the endogenous protein with between 40 and 50 amino acids of another protein, but can involve fewer or more amino acids.

As used herein, an epidermal growth factor (EGF) domain (EGF-1 or EGF-2) refers to the portion of a protein that shares sequence homology to a specific 30 to 40 amino acid portion of the epidermal growth factor (EGF) sequence. The EGF domain includes six cysteine residues that have been shown (in EGF) to be involved in disulfide bonds. The main structure of an EGF domain is a two-stranded beta-sheet followed by a loop to a C-terminal short two-stranded sheet. FVII contains two EGF domains: EGF-1 and EGF-2. These domains correspond to amino acid positions 46-82, and 87-128, respectively, of the mature FVII polypeptide set forth in SEQ ID NO:3.

As used herein, "unmodified polypeptide" or "unmodified FVII" and grammatical variations thereof refer to a starting polypeptide that is selected for modification as provided herein. The starting polypeptide can be a naturally-occurring, wild-type form of a polypeptide. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in a amino acid residue or residues to alter glycosylation, can be a target protein, referred to herein as unmodified, for further modification of either the same or a different property. Exemplary modified FVII polypeptides known in the art include any FVII polypeptide described in, for example, U.S. Pat. Nos. 5,580,560, 6,017,882, 6,693,075, 6,762,286 and 6,806,063, U.S. Patent Publication Nos. 20030100506 and 20040220106 and International Patent Publication Nos. WO1988010295, WO200183725, WO2003093465, WO200338162, WO2004083361, WO2004108763, WO2004029090, WO2004029091, WO2004111242 and WO2005123916.

As used herein, "modified factor VII polypeptides" and "modified factor VII" refer to a FVII polypeptide that has one or more amino acid differences compared to an unmodified factor VII polypeptide. The one or more amino acid differences can be amino acid mutations such as one or more amino acid replacements (substitutions), insertions or deletions, or can be insertions or deletions of entire domains, and any combinations thereof. Typically, a modified FVII polypeptide has one or more modifications in primary sequence compared to an unmodified FVII polypeptide. For example, a modified FVII polypeptide provided herein can have 1, 2, 3, 4, 5, 6, 7, 8, 9, 10, 11, 12, 13, 14, 15, 16, 17, 18, 19, 20, 30, 40, 50 or more amino acid differences compared to an unmodified FVII polypeptide. Any modification is contemplated as long as the resulting polypeptide exhibits at least one FVII activity associated with a native FVII polypeptide, such as, for example, catalytic activity, proteolytic activity, the ability to bind TF or the ability to bind activated platelets.

As used herein, "inhibitors of coagulation" refer to proteins or molecules that act to inhibit or prevent coagulation or clot formation. The inhibition or prevention of coagulation can be observed in vivo or in vitro, and can be assayed using any method known in the art including, but not limited to, pro-thromboplastin time (PT) assay or the activated partial thromboplastin time (aPTT) assay.

As used herein, tissue factor pathway inhibitor (TFPI, also referred to as TFPI-1) is a Kunitz-type inhibitor that is involved in the formation of a quaternary TF/FVIIa/TFPI/FXa inhibitory complex in which the activity of FVIIa is inhibited. TFPI is expressed as two different precursor forms following alternative splicing, TFPIα (SEQ ID NO:75) and TFPIβ (SEQ ID NO:77) precursors, which are cleaved during secretion to generate a 276 amino acid (SEQ ID NO:76) and a 223 amino acid (SEQ ID NO:78) mature protein, respectively. TFPI contains 3 Kunitz domains, of which the Kunitz-1 domain is responsible for binding and inhibition of FVIIa.

As used herein, TFPI-2 (also is known as placental protein 5 (PP5) and matrix-associated serine protease inhibitor (MSPI)) refers to a homolog of TFPI. The 213 amino acid mature TFPI-2 protein (SEQ ID NO:79) contains three Kunitz-type domains that exhibit 43%, 35% and 53% primary sequence identity with TFPI-1 Kunitz-type domains 1, 2, and 3, respectively. TFPI-2 plays a role in the regulation of extracellular matrix digestion and remodeling, and is not thought to be an important factor in the coagulation pathway.

As used herein, antithrombin III (AT-III) is a serine protease inhibitor (serpin). AT-III is synthesized as a precursor protein containing 464 amino acid residues (SEQ ID NO:95) that is cleaved during secretion to release a 432 amino acid mature antithrombin (SEQ ID NO:96).

As used herein, cofactors refer to proteins or molecules that bind to other specific proteins or molecules to form an active complex. In some examples, binding to a cofactor is required for optimal proteolytic activity. For example, tissue factor (TF) is a cofactor of FVIIa. Binding of FVIIa to TF induces conformational changes that result in increased proteolytic activity of FVIIa for its substrates, FX and FIX.

As used herein, tissue factor (TF) refers to a 263 amino acids transmembrane glycoprotein (SEQ ID NO:97) that functions as a cofactor for FVIIa. It is constitutively expressed by smooth muscle cells and fibroblasts, and helps to initiate coagulation by binding FVII and FVIIa when these cells come in contact with the bloodstream following tissue injury.

As used herein, activated platelet refers to a platelet that has been triggered by the binding of molecules such as collagen, thromboxane A2, ADP and thrombin to undergo various changes in morphology, phenotype and function that ultimately promote coagulation. For example, an activated platelet changes in shape to a more amorphous form with projecting fingers. Activated platelets also undergo a "flip" of the cell membrane such that phosphatidylserine and other negatively charged phospholipids that are normally present in the inner leaflet of the cell membrane are translocated to the outer, plasma-oriented surface. These membranes of the activated platelets provide the surface on which many of the reactions of the coagulation cascade are effected. Activated platelets also secrete vesicles containing such pro-coagulant factors as vWF, FV, thrombin, ADP and thromboxane A2, and adhere to one another to form a platelet plug which is stabilized by fibrin to become a clot.

As used herein, increased binding and/or affinity for activated platelets, and any grammatical variations thereof, refers to an enhanced ability of a polypeptide or protein, for example a FVII polypeptide, to bind to the surface of an activated platelet, as compared with a reference polypeptide or protein. For example, the ability of a modified FVII polypeptide to bind to activated platelets can be greater than the ability of the unmodified FVII polypeptide to bind to activated platelets. The binding and/or affinity of a polypeptide for activated platelets can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the binding and/or affinity of an unmodified polypeptide. Assays to determine the binding and/or affinity of a polypeptide for activated platelets are known in the art. Binding of a FVII polypeptide to activated platelets is mediated through the interaction of amino acids in the Gla domain of the FVII polypeptide and negatively charged phospholipids, such as phosphatidylserine, on the activated platelet. As such, methods to assay for binding of polypeptides, such as FVII polypeptides, to activated platelets use membranes and vesicles that contain phospholipids, such as phosphatidylserine. For example, the ability of a polypeptide to bind to an activated platelet is reflected by the ability of the polypeptide to bind to phospholipid vesicles, which can be measured by light scattering techniques.

As used herein, increased binding and/or affinity for phospholipids, and any grammatical variations thereof, refers to an enhanced ability of a polypeptide or protein to bind to phospholipids as compared with a reference polypeptide or protein. Phospholipids can include any phospholipids, but particularly include phosphatidylserine. The binding and/or affinity of a polypeptide for phospholipids can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the binding and/or affinity of an unmodified polypeptide. Assays to determine the affinity and/or binding of a polypeptide to phospholipids are known in the art. For example, FVII polypeptide binding to phospholipid vesicles can be determined by relative light scattering at 90° to the incident light. The intensity of the light scatter with the phospholipid vesicles alone and with phospholipid vesicles with FVII is measured to determine the dissociation constant. Surface plasma resonance, such as on a BIAcore biosensor instrument, also can be used to measure the affinity of FVII polypeptides for phospholipid membranes.

As used herein, increased resistance to inhibitors or "increased resistance to AT-III" or "increased resistance to TFPI" refers to any amount of decreased sensitivity of a polypeptide to the inhibitory effects of an inhibitor, such as AT-III or TFPI, compared with a reference polypeptide, such as an unmodified FVII polypeptide. Increased resistance to an inhibitor, such as AT-III, can be assayed by assessing the binding of a modified FVII polypeptide to an inhibitor. Increased resistance to an inhibitor, such as AT-III, also can be assayed by measuring the intrinsic activity or coagulant activity of a FVII polypeptide in the presence of AT-III. Assays to determine the binding of a polypeptide to an inhibitor are known in the art. For covalent inhibitors, such as, for example, AT-III, a second order rate constant for inhibition can be measured. For non-covalent inhibitors, such as, for example, TFPI, a $k_i$ can be measured. In addition, surface plasma resonance, such as on a BIAcore biosensor instrument, also can be used to measure the binding of FVII polypeptides to AT-III or other inhibitors. However, for covalent inhibitors such as AT-III, only an on-rate can be measured using BIAcore. Assays to determine the inhibitory effect of, for example, AT-III on FVII coagulant activity or intrinsic activity also are known in the art. For example, the ability of a modified FVII polypeptide to cleave its substrate FX in the presence or absence of AT-III can be measured, and the degree to which AT-III inhibits the reaction determined. This can be compared to the ability of an unmodified FVII polypeptide to cleave its substrate FX in the presence or absence of AT-III. A modified polypeptide that exhibits increased resistance to an inhibitor exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more resistance to the effects of an inhibitor compared to an unmodified polypeptide.

As used herein, "increased resistance to inhibition by $Zn^{2+}$," "increased resistance to the inhibitory effects of $Zn^{2+}$" or "increased resistance to $Zn^{2+}$" refers to any amount of decreased sensitivity of a polypeptide to the inhibitory effects of $Zn^{2+}$ compared with a reference polypeptide, such as an unmodified FVII polypeptide. Increased resistance to $Zn^{2+}$ can be assayed by, for example, measuring the intrinsic activity or coagulant activity of a FVII polypeptide in the presence of $Zn^{2+}$, such as described in Example 11. Increased resistance to the inhibitory effects of $Zn^{2+}$ can be the result of decreased binding to $Zn^{2+}$. Decreased binding to $Zn^{2+}$ can be assayed by measuring the amount of bound $Zn^{2+}$ per molecule of FVIIa or by measuring the affinity of $Zn^{2+}$ binding to FVIIa or by measuring an $IC_{50}$ for inhibition of a FVIIa activity by zinc. A modified polypeptide that exhibits increased resistance to the inhibitory effects of $Zn^{2+}$ exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more resistance to the effects of $Zn^{2+}$ compared to an unmodified polypeptide.

As used herein, a serum albumin binding sequence refers to a sequence of amino acid residues that can effect binding to serum albumin. Thus, when inserted into a FVII polypeptide, the serum albumin binding sequence can enhance the affinity for or binding to serum albumin of the FVII polypeptide. The ability of the modified FVII polypeptide containing the serum albumin binding sequence can therefore exhibit increased binding and/or affinity for serum albumin. A modified polypeptide that exhibits increased binding and/or affinity for serum albumin exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more compared to the binding and/or affinity of an unmodified polypeptide. Typically, serum albumin binding sequences contain at least 10 or more amino acids, typically 10, 11, 12, 13, 14, 15, 20, 30, 40 or more amino acids. Exemplary of serum albumin binding sequences are those set forth in SEQ ID NOS:103-109.

As used herein, a platelet integrin $\alpha_{IIb}\beta_3$ binding sequence refers to a sequence of amino acid residues that can effect binding to platelet integrin $\alpha_{IIb}\beta_3$. Thus, when inserted into a FVII polypeptide, the platelet integrin $\alpha_{IIb}\beta_3$ binding sequence can enhance the ability of the FVII polypeptide to bind to platelet integrin $\alpha_{IIb}\beta_3$ and, therefore, platelets, including activated platelets. The ability of the modified FVII polypeptide containing the platelet integrin $\alpha_{IIb}\beta_3$ binding sequence can therefore exhibit increased binding and/or affinity for platelet integrin $\alpha_{IIb}\beta_3$ and/or platelets. A modified polypeptide that exhibits increased binding and/or affinity for platelet integrin $\alpha_{IIb}\beta_3$ exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more compared to the binding and/or affinity of an unmodified polypeptide. Typically, platelet integrin $\alpha_{IIb}\beta_3$ binding sequences contain at least 5 or more amino acids, typically 5, 6, 7, 8, 9, 10, 11, 12, 13, 14, 15, 20, 30, 40 or more amino acids. Exemplary of platelet integrin $\alpha_{IIb}\beta_3$ binding sequences are those set forth in SEQ ID NOS:110-112.

As used herein, a glycosylation site refers to an amino position in a polypeptide to which a carbohydrate moiety can be attached. Typically, a glycosylated protein contains one or more amino acid residues, such as asparagine or serine, for the attachment of the carbohydrate moieties.

As used herein, a native glycosylation site refers to an amino position to which a carbohydrate moiety is attached in a wild-type polypeptide. There are four native glycosylation sites in FVII; two N-glycosylation sites at N145 and N322, and two O-glycosylation sites at S52 and S60, corresponding to amino acid positions in the mature FVII polypeptide set forth in SEQ ID NO:3.

As used herein, a non-native glycosylation site refers to an amino position to which a carbohydrate moiety is attached in a modified polypeptide that is not present in a wild-type polypeptide. Non-native glycosylation sites can be introduced into a FVII polypeptide by amino acid replacement. O-glycosylation sites can be created, for example, by amino acid replacement of a native residue with a serine or threonine. N-glycosylation sites can be created, for example, by establishing the motif Asn-Xaa-Ser/Thr/Cys, where Xaa is not proline. Creation of this consensus sequence by amino acid modification can involve, for example, a single amino acid replacement of a native amino acid residue with an asparagine, a single amino acid replacement of a native amino acid residue with a serine, threonine or cysteine, or a double amino acid replacement involving a first amino acid replacement of a native residue with an asparagine and a second amino acid replacement of native residue with a serine, threonine or cysteine.

As used herein, "biological activity" refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a FVII polypeptide encompasses the coagulant activity.

As used herein the term "assess", and grammatical variations thereof, is intended to include quantitative and qualitative determination in the sense of obtaining an absolute value for the activity of a polypeptide, and also of obtaining an index, ratio, percentage, visual or other value indicative of the level of the activity. Assessment can be direct or indirect. For example, detection of cleavage of a substrate by a polypeptide can be by direct measurement of the product, or can be indirectly measured by determining the resulting activity of the cleaved substrate.

As used herein, "chymotrypsin numbering" refers to the amino acid numbering of a mature chymotrypsin polypeptide of SEQ ID NO:80. Alignment of a protease domain of another protease, such as for example the protease domain of factor VII, can be made with chymotrypsin. In such an instance, the amino acids of factor VII that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. The corresponding chymotrypsin numbers of amino acid positions 1 to 406 of the FVII polypeptide set forth in SEQ ID NO:3 are provided in Table 1. The amino acid positions relative to the sequence set forth in SEQ ID NO:3 are in normal font, the amino acid residues at those positions are in bold, and the corresponding chymotrypsin numbers are in italics. For example, upon alignment of the mature factor VII (SEQ ID NO:3) with mature chymotrypsin (SEQ ID NO:80), the isoleucine (I) at amino acid position 153 in factor VII is given the chymotrypsin numbering of I16. Subsequent amino acids are numbered accordingly. In one example, a glutamic acid (E) at amino acid position 210 of the mature factor VII (SEQ ID NO:3) corresponds to amino acid position E70 based on chymotrypsin numbering. Where a residue exists in a protease, but is not present in chymotrypsin, the amino acid residue is given a letter notation. For example, residues in chymotrypsin that are part of a loop with amino acid 60 based on chymotrypsin numbering, but are inserted in the factor VII sequence compared to chymotrypsin, are referred to for example as K60a, 160b, K60c or N60d. These residues correspond to K197, I198, K199 and N200, respectively, by numbering relative to the mature factor VII sequence (SEQ ID NO:3).

TABLE 1

Chymotryspin numbering of factor VII

| 153 | 154 | 155 | 156 | 157 | 158 | 159 | 160 | 161 | 162 | 163 | 164 | 165 | 166 | 167 |
|---|---|---|---|---|---|---|---|---|---|---|---|---|---|---|
| I | V | G | G | K | V | C | P | K | G | E | C | P | W | Q |
| 16 | 17 | 18 | 19 | 20 | 21 | 22 | 23 | 24 | 25 | 26 | 27 | 28 | 29 | 30 |
| 168 | 169 | 170 | 171 | 172 | 173 | 174 | 175 | 176 | 177 | 178 | 179 | 180 | 181 | 182 |
| V | L | L | L | V | N | G | A | Q | L | C | G | G | T | L |
| 31 | 32 | 33 | 34 | 35 | 37 | 38 | 39 | 40 | 41 | 42 | 43 | 44 | 45 | 46 |
| 183 | 184 | 185 | 186 | 187 | 188 | 189 | 190 | 191 | 192 | 193 | 194 | 195 | 196 | 197 |
| I | N | T | I | W | V | V | S | A | A | H | C | F | D | K |
| 47 | 48 | 49 | 50 | 51 | 52 | 53 | 54 | 55 | 56 | 57 | 58 | 59 | 60 | 60A |
| 198 | 199 | 200 | 201 | 202 | 203 | 204 | 205 | 206 | 207 | 208 | 209 | 210 | 211 | 212 |
| I | K | N | W | R | N | L | I | A | V | L | G | E | H | D |
| 60B | 60C | 60D | 61 | 62 | 63 | 64 | 65 | 66 | 67 | 68 | 69 | 70 | 71 | 72 |
| 213 | 214 | 215 | 216 | 217 | 218 | 219 | 220 | 221 | 222 | 223 | 224 | 225 | 226 | 227 |
| L | S | E | H | D | G | D | E | Q | S | R | R | V | A | Q |
| 73 | 74 | 75 | 76 | 77 | 78 | 79 | 80 | 81 | 82 | 83 | 84 | 85 | 86 | 87 |
| 228 | 229 | 230 | 231 | 232 | 233 | 234 | 235 | 236 | 237 | 238 | 239 | 240 | 241 | 242 |
| V | I | I | P | S | T | Y | V | P | G | T | T | N | H | D |
| 88 | 89 | 90 | 91 | 92 | 93 | 94 | 95 | 96 | 97 | 98 | 99 | 100 | 101 | 102 |
| 243 | 244 | 245 | 246 | 247 | 248 | 249 | 250 | 251 | 252 | 253 | 254 | 255 | 256 | 257 |
| I | A | L | L | R | L | H | Q | P | V | V | L | T | D | H |
| 103 | 104 | 105 | 106 | 107 | 108 | 109 | 110 | 111 | 112 | 113 | 114 | 115 | 116 | 117 |
| 258 | 259 | 260 | 261 | 262 | 263 | 264 | 265 | 266 | 267 | 268 | 269 | 270 | 271 | 272 |
| V | V | P | L | C | L | P | E | R | T | F | S | E | R | T |
| 118 | 119 | 120 | 121 | 122 | 123 | 124 | 125 | 126 | 127 | 128 | 129 | 129A | 129B | 129C |
| 273 | 274 | 275 | 276 | 277 | 278 | 279 | 280 | 281 | 282 | 283 | 284 | 285 | 286 | 287 |
| L | A | F | V | R | F | S | L | V | S | G | W | G | Q | L |
| 129D | 129E | 129F | 129G | 134 | 135 | 136 | 137 | 138 | 139 | 140 | 141 | 142 | 143 | 144 |
| 288 | 289 | 290 | 291 | 292 | 293 | 294 | 295 | 296 | 297 | 298 | 299 | 300 | 301 | 302 |
| L | D | R | G | A | T | A | L | E | L | M | V | L | N | V |
| 145 | 146 | 147 | 149 | 150 | 151 | 152 | 153 | 154 | 155 | 156 | 157 | 158 | 159 | 160 |
| 303 | 304 | 305 | 306 | 307 | 308 | 309 | 310 | 311 | 312 | 313 | 314 | 315 | 316 | 317 |
| P | R | L | M | T | Q | D | C | L | Q | Q | S | R | K | V |
| 161 | 162 | 163 | 164 | 165 | 166 | 167 | 168 | 169 | 170 | 170A | 170B | 170C | 170D | 170E |
| 318 | 319 | 320 | 321 | 322 | 323 | 324 | 325 | 326 | 327 | 328 | 329 | 330 | 331 | 332 |
| G | D | S | P | N | I | T | E | Y | M | F | C | A | G | Y |
| 170F | 170G | 170H | 170I | 175 | 176 | 177 | 178 | 179 | 180 | 181 | 182 | 183 | 184A | 184 |
| 333 | 334 | 335 | 336 | 337 | 338 | 339 | 340 | 341 | 342 | 343 | 344 | 345 | 346 | 347 |
| S | D | G | S | K | D | S | C | K | G | D | S | G | G | P |
| 185 | 186 | 187 | 188A | 188 | 189 | 190 | 191 | 192 | 193 | 194 | 195 | 196 | 197 | 198 |
| 348 | 349 | 350 | 351 | 352 | 353 | 354 | 355 | 356 | 357 | 358 | 359 | 360 | 361 | 362 |
| H | A | T | H | Y | R | G | T | W | Y | L | T | G | I | V |
| 199 | 200 | 201 | 202 | 203 | 204 | 205 | 206 | 207 | 208 | 209 | 210 | 211 | 212 | 213 |
| 363 | 364 | 365 | 366 | 367 | 368 | 369 | 370 | 371 | 372 | 373 | 374 | 375 | 376 | 377 |
| S | W | G | Q | G | C | A | T | V | G | H | F | G | V | Y |
| 214 | 215 | 216 | 217 | 219 | 220 | 221A | 221 | 222 | 223 | 224 | 225 | 226 | 227 | 228 |

TABLE 1-continued

| Chymotryspin numbering of factor VII | | | | | | | | | | | | | | |
|---|---|---|---|---|---|---|---|---|---|---|---|---|---|---|
| 378 | 379 | 380 | 381 | 382 | 383 | 384 | 385 | 386 | 387 | 388 | 389 | 390 | 391 | 392 |
| T | R | V | S | Q | Y | I | E | W | L | Q | K | L | M | R |
| 229 | 230 | 231 | 232 | 233 | 234 | 235 | 236 | 237 | 238 | 239 | 240 | 241 | 242 | 243 |
| 393 | 394 | 395 | 396 | 397 | 398 | 399 | 400 | 401 | 402 | 403 | | 404 | 405 | 406 |
| S | E | P | R | P | G | V | L | L | R | A | | P | F | P |
| 244 | 245 | 246 | 247 | 248 | 249 | 250 | 251 | 252 | 253 | 254 | | 255 | 256 | 257 |

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids that occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

In keeping with standard polypeptide nomenclature described in *J. Biol. Chem.*, 243: 3557-3559 (1968), and adopted 37 C.F.R. §§1.821-1.822, abbreviations for the amino acid residues are shown in Table 2:

TABLE 2

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |

TABLE 2-continued

Table of Correspondence

| SYMBOL | | |
|---|---|---|
| 1-Letter | 3-Letter | AMINO ACID |
| D | Asp | aspartic acid |
| N | Asn | asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 2) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, a "hydrophobic amino acid" includes any one of the amino acids determined to be hydrophobic using the Eisenberg hydrophobicity consensus scale. Exemplary are the naturally occurring hydrophobic amino acids, such as isoleucine, phenylalanine, valine, leucine, tryptophan, methionine, alanine, glycine, cysteine and tyrosine (Eisenberg et al., (1982) Faraday Symp. Chem. Soc. 17:109-120). Non-naturally-occurring hydrophobic amino acids also are included.

As used herein, an "acidic amino acid" includes among the naturally-occurring amino acids aspartic acid and glutamic acid residues. Non-naturally-occurring acidic amino acids also are included.

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 2. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art and can be included in a modified factor VII polypeptide.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used interchangeably, but homology for proteins can include conservative amino acid changes. In general to identify corresponding positions the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology varies). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215:403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) that are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, isolated or purified polypeptide or protein or biologically-active portion thereof is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant methods by using recombinant DNA methods refers to the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. Selection and use of such vehicles are well known to those of skill in the art.

As used herein, expression refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans.

As used herein, naked DNA refers to histone-free DNA that can be used for vaccines and gene therapy. Naked DNA is the genetic material that is passed from cell to cell during a gene transfer processed called transformation or transfection. In transformation or transfection, purified or naked DNA that is taken up by the recipient cell will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" refers to a polypeptide operatively-linked to a different polypeptide. A chimeric or fusion protein provided herein can include one or more FVII polypeptides, or a portion thereof, and one or more other polypeptides for any one or more of a transcriptional/translational control signals, signal sequences, a tag for localization, a tag for purification, part of a domain of an immunoglobulin G, and/or a targeting agent. A chimeric FVII polypeptide also includes those having their endogenous domains or regions of the polypeptide exchanged with another polypeptide. These chimeric or fusion proteins include those produced by recombinant means as fusion proteins, those produced by chemical means, such as by chemical coupling, through, for example, coupling to sulfhydryl groups, and those produced by any other method whereby at least one polypeptide (i.e. FVII), or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent, is any moiety, such as a protein or effective portion thereof, that provides specific binding to a cell surface molecule, such a cell surface receptor, which in some instances can internalize a bound conjugate or portion thereof. A targeting agent also can be one that promotes or facilitates, for example, affinity isolation or purification of the conjugate; attachment of the conjugate to a surface; or detection of the conjugate or complexes containing the conjugate.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving coagulation, including those mediated by coagulation proteins and those in which coagulation proteins play a role in the etiology or pathology. Diseases and disorders also include those that are caused by the absence of a protein such as in hemophilia, and of particular interest herein are those disorders where coagulation does not occur due to a deficiency of defect in a coagulation protein.

As used herein, "procoagulant" refers to any substance that promotes blood coagulation.

As used herein, "anticoagulant" refers to any substance that inhibits blood coagulation As used herein, "hemophilia" refers to a bleeding disorder caused by a deficiency in a blood clotting factors. Hemophilia can be the result, for example, of absence, reduced expression, or reduced function of a clotting factor. The most common type of hemophilia is hemophilia A, which results from a deficiency in factor VIII. The second most common type of hemophilia is hemophilia B, which results from a deficiency in factor IX. Hemophilia C, also called FXI deficiency, is a milder and less common form of hemophila.

As used herein, "congenital hemophilia" refers to types of hemophilia that are inherited. Congenital hemophilia results from mutation, deletion, insertion, or other modification of a clotting factor gene in which the production of the clotting factor is absent, reduced, or non-functional. For example, hereditary mutations in clotting factor genes, such as factor VIII and factor IX result in the congenital hemophilias, Hemophilia A and B, respectively.

As used herein, "acquired hemophilia" refers to a type of hemophilia that develops in adulthood from the production of autoantibodies that inactivate FVIII.

As used herein, "bleeding disorder" refers to a condition in which the subject has a decreased ability to control bleeding. Bleeding disorders can be inherited or acquired, and can result from, for example, defects or deficiencies in the coagulation pathway, defects or deficiencies in platelet activity, or vascular defects.

As used herein, "acquired bleeding disorder" refers to bleeding disorders that results from clotting deficiencies caused by conditions such as liver disease, vitamin K deficiency, or coumadin (warfarin) or other anti-coagulant therapy.

As used herein, "treating" a subject having a disease or condition means that a polypeptide, composition or other product provided herein is administered to the subject.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease are ameliorated or otherwise beneficially altered. Hence treatment encompasses prophylaxis, therapy and/or cure. Treatment also encompasses any pharmaceutical use of the compositions herein. Treatment also encompasses any pharmaceutical use of a modified FVII and compositions provided herein.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced. Prophylaxis includes reduction in the risk of developing a disease or condition and/or a prevention of worsening of symptoms or progression of a disease or reduction in the risk of worsening of symptoms or progression of a disease.

As used herein an effective amount of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, "therapeutically effective amount" or "therapeutically effective dose" refers to an agent, compound, material, or composition containing a compound that is at least sufficient to produce a therapeutic effect. An effective amount is the quantity of a therapeutic agent necessary for preventing, curing, ameliorating, arresting or partially arresting a symptom of a disease or disorder.

As used herein, "patient" or "subject" to be treated includes humans and or non-human animals, including mammals. Mammals include primates, such as humans, chimpanzees, gorillas and monkeys; domesticated animals, such as dogs, horses, cats, pigs, goats, cows; and rodents such as mice, rats, hamsters and gerbils.

As used herein, a combination refers to any association between two or among more items. The association can be spatial or refer to the use of the two or more items for a common purpose.

As used herein, a composition refers to any mixture of two or more products or compounds (e.g., agents, modulators, regulators, etc.). It can be a solution, a suspension, liquid, powder, a paste, aqueous or non-aqueous formulations or any combination thereof.

As used herein, an "article of manufacture" is a product that is made and sold. As used throughout this application, the term is intended to encompass modified protease polypeptides and nucleic acids contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a packaged combination, optionally including reagents and other products and/or components for practicing methods using the elements of the combination. For example, kits containing a modified protease polypeptide or nucleic acid molecule provided herein and another item for a purpose including, but not limited to, administration, diagnosis, and assessment of a biological activity or property are provided. Kits optionally include instructions for use.

As used herein, antibody includes antibody fragments, such as Fab fragments, which are composed of a light chain and the variable region of a heavy chain.

As used herein, a receptor refers to a molecule that has an affinity for a particular ligand. Receptors can be naturally-occurring or synthetic molecules. Receptors also can be referred to in the art as anti-ligands.

As used herein, animal includes any animal, such as, but not limited to; primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The proteases provided herein are from any source, animal, plant, prokaryotic and fungal.

As used herein, gene therapy involves the transfer of heterologous nucleic acid, such as DNA, into certain cells, target cells, of a mammal, particularly a human, with a disorder or condition for which such therapy is sought. The nucleic acid, such as DNA, is introduced into the selected target cells, such as directly or in a vector or other delivery vehicle, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that in some manner mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound, such as a protease or modified protease, that is not normally produced in the mammalian host or that is not produced in therapeutically effective amounts or at a therapeutically useful time. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, heterologous nucleic acid is nucleic acid that is not normally produced in vivo by the cell in which it is expressed or that is produced by the cell but is at a different locus or expressed differently or that mediates or encodes mediators that alter expression of endogenous nucleic acid, such as DNA, by affecting transcription, translation, or other regulatable biochemical processes. Heterologous nucleic acid is generally not endogenous to the cell into which it is introduced, but has been obtained from another cell or prepared synthetically. Heterologous nucleic acid can be endogenous, but is nucleic acid that is expressed from a different locus or altered in its expression. Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous).

Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, a therapeutically effective product for gene therapy is a product that is encoded by heterologous nucleic acid, typically DNA, that, upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, recitation that a polypeptide "consists essentially" of a recited sequence of amino acids means that only the recited portion, or a fragment thereof, of the full-length polypeptide is present. The polypeptide can optionally, and generally will, include additional amino acids from another source or can be inserted into another polypeptide As used herein, the singular forms "a," "an" and "the" include plural referents unless the context clearly dictates otherwise. Thus, for example, reference to compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Hemostasis Overview

Provided herein are modified Factor VII (FVII) polypeptides. Such FVII polypeptides are designed to have increased coagulant activity. Accordingly, these polypeptides have a variety of uses and applications, for example, as therapeutics for modulating hemostasis, and other related biological processes. To appreciate the modifications provided herein and the use of such modified FVII molecules, an understanding of the haemostatic system and the blood coagulation cascade is advantageous. The following discussion provides such background, prefatory to a discussion of factor VII, and modifications thereof.

Hemostasis is the physiological mechanism that stems the bleeding that results from injury to the vasculature. Normal hemostasis depends on cellular components and soluble plasma proteins, and involves a series of signaling events that ultimately leads to the formation of a blood clot. Coagulation is quickly initiated after an injury occurs to the blood vessel and endothelial cells are damaged. In the primary phase of coagulation, platelets are activated to form a haemostatic plug at the site of injury. Secondary hemostasis follows involving plasma coagulation factors, which act in a proteolytic cascade resulting in the formation of fibrin strands which strengthen the platelet plug.

Upon vessel injury, the blood flow to the immediate injured area is restricted by vascular constriction allowing platelets to adhere to the newly-exposed fibrillar collagen on the subendothelial connective tissue. This adhesion is dependent upon the von Willebrand factor (vWF), which binds to the endothelium within three seconds of injury, thereby facilitating platelet adhesion and aggregation. Activation of the aggregated platelets results in the secretion of a variety of factors, including ADP, ATP, thromboxane and serotonin. Adhesion molecules, fibrinogen, vWF, thrombospondin and fibronectin also are released. Such secretion promotes additional adhesion and aggregation of platelets, increased platelet activation and blood vessel constriction, and exposure of anionic phospholipids on the platelet surface that serve as platforms for the assembly of blood coagulation enzyme complexes. The platelets change shape leading to pseudopodia formation, which further facilitates aggregation to other platelets resulting in a loose platelet plug.

A clotting cascade of peptidases (the coagulation cascade) is simultaneously initiated. The coagulation cascade involves a series of activation events involving proteolytic cleavage. In such a cascade, an inactive protein of a serine protease (also called a zymogen) is converted to an active protease by cleavage of one or more peptide bonds, which then serves as the activating protease for the next zymogen molecule in the cascade, ultimately resulting in clot formation by the cross-linking of fibrin. For example, the cascade generates activated molecules such as thrombin (from cleavage of prothrombin), which further activates platelets, and also generates fibrin from cleavage of fibrinogen. Fibrin then forms a cross-linked polymer around the platelet plug to stabilize the clot. Upon repair of the injury, fibrin is digested by the fibrinolytic system, the major components of which are plasminogen and tissue-type plasminogen activator (tPA). Both of these proteins are incorporated into polymerizing fibrin, where they interact to generate plasmin, which, in turn, acts on fibrin to dissolve the preformed clot. During clot formation, coagulation factor inhibitors also circulate through the blood to prevent clot formation beyond the injury site.

The interaction of the system, from injury to clot formation and subsequent fibrinolysis, is described below.

1. Platelet Adhesion and Aggregation

The clotting of blood is actively circumvented under normal conditions. The vascular endothelium supports vasodilation, inhibits platelet adhesion and activation, suppresses coagulation, enhances fibrin cleavage and is anti-inflammatory in character. Vascular endothelial cells secrete molecules such as nitrous oxide (NO) and prostacylin, which inhibit platelet aggregation and dilate blood vessels. Release of these molecules activates soluble guanylate cyclases (sGC) and cGMP-dependent protein kinase I (cGKI) and increases cyclic guanosine monophosphate (cGMP) levels, which cause relaxation of the smooth muscle in the vessel wall. Furthermore, endothelial cells express cell-surface ADPases, such as CD39, which control platelet activation and aggregation by converting ADP released from platelets into adenine nucleotide platelet inhibitors. The endothelium also plays an important role in the regulation of the enzymes in the fibrinolytic cascade. Endothelial cells directly promote the generation of plasmin through the expression of receptors of plasminogen (annexin II) and urokinase, as well as the secretion of tissue-type and urokinase plasminogen activators, all of which promote clot clearance. In a final layer of prothrombotic regulation, endothelial cells play an active role in inhibiting the coagulation cascade by producing heparan sulfate, which increases the kinetics of antithrombin III inhibition of thrombin and other coagulation factors.

Under acute vascular trauma, however, vasoconstrictor mechanisms predominate and the endothelium becomes prothrombotic, procoagulatory and proinflammatory in nature. This is achieved by a reduction of endothelial dilating agents: adenosine, NO and prostacyclin; and the direct action of ADP, serotonin and thromboxane on vascular smooth muscle cells to elicit their contraction (Becker, Heindl et al. 2000). The chief trigger for the change in endothelial function that leads to the formation of haemostatic thrombus is the loss of the endothelial cell barrier between blood and extracellular matrix (ECM) components (Ruggeri (2002) Nat Med 8:1227-1234). Circulating platelets identify and discriminate areas of endothelial lesions and adhere to the exposed sub endothelium. Their interaction with the various thrombogenic substrates and locally-generated or released agonists results in platelet activation. This process is described as possessing two stages, 1) adhesion: the initial tethering to a surface, and 2) aggregation: the platelet-platelet cohesion (Savage et al. (2001) Curr Opin Hematol 8:270-276).

Platelet adhesion is initiated when the circulating platelets bind to exposed collagen through interaction with collagen binding proteins on the cell surface, and through interaction with vWF, also present on the endothelium. vWF protein is a multimeric structure of variable size, secreted in two directions by the endothelium; basolaterally and into the bloodstream. vWF also binds to factor VIII, which is important in the stabilization of factor VIII and its survival in the circulation.

Platelet adhesion and subsequent activation is achieved when vWF binds via its A1 domain to GPIb (part of the platelet glycoprotein receptor complex GPIb-IX-V). The interaction between vWF and GPIb is regulated by shear force such that an increase in the shear stress results in a corresponding increase in the affinity of vWF for GPIb. Integrin α1β2, also known on leukocytes as VLA-2, is the major collagen receptor on platelets, and engagement through this receptor generates the intracellular signals that contribute to platelet activation. Binding through α1β2 facilitates the engagement of the lower-affinity collagen receptor, GP VI. This is part of the immunoglobulin superfamily and is the receptor that generates the most potent intracellular signals for platelet activation. Platelet activation results in the release of adenosine diphosphate (ADP), which is converted to thromboxane A2.

Platelet activation also results in the surface expression of platelet glycoprotein IIb-IIIa (GP IIb-IIIa) receptors, also known as platelet integrin $\alpha_{IIb}\beta_3$. GP IIb-IIIa receptors allow the adherence of platelets to each other (i.e. aggregation) by virtue of fibrinogen molecules linking the platelets through these receptors. This results in the formation of a platelet plug at the site of injury to help prevent further blood loss, while the damaged vascular tissue releases factors that initiate the coagulation cascade and the formation of a stabilizing fibrin mesh around the platelet plug.

2. Coagulation Cascade

The coagulation pathway is a proteolytic pathway where each enzyme is present in the plasma as a zymogen, or inactive form. Cleavage of the zymogen is regulated to release the active form from the precursor molecule. Cofactors of the activated proteases, such as the glycoproteins FVIII and FV, also are activated in the cascade reaction and play a role in clot formation. The pathway functions as a series of positive and negative feedback loops which control the activation process, where the ultimate goal is to produce thrombin, which can then convert soluble fibrinogen into fibrin to form a clot. The factors in the coagulation are typically given a roman numeral number, with a lower case "a" appended to indicate an activated form. Table 3 below sets forth an exemplary list of the factors, including their common name, and their role in the coagulation cascade. Generally, these proteins participate in blood coagulation through one or more of the intrinsic, extrinsic or common pathway of coagulation (see FIG. 1). As discussed below, these pathways are interconnected, and blood coagulation is believed to occur through a cell-based model of activation with Factor VII (FVII) being the primary initiator of coagulation.

TABLE 3

Coagulation Factors

| Factor | Common Name | Pathway | Characteristic |
|---|---|---|---|
| I | Fibrinogen | Both | — |
| II | Prothrombin | Both | Contains N-terminal Gla domain |
| III | Tissue Factor | Extrinsic | — |
| IV | Calcium | Both | — |
| V | Proaccelerin, labile factor, Accelerator globulin | Both | Protein cofactor |
| VI (Va) | Accelerin | — | (Redundant to factor V) |
| VII | Proconvertin, serum prothrombin conversion accelerator (SPCA) cothromboplastin | Extrinsic | Endopeptidase with Gla domain |
| VIII | Antihemophiliac factor A, antihemophiliac globulin (AHG) | Intrinsic | Protein cofactor |
| IX | Christmas factor, antihemophiliac factor B, plasma thromboplastin component (PTC) | Intrinsic | Endopeptidase with Gla domain |
| X | Stuart-prower factor | Both | Endopeptidase with Gla domain |
| XI | Plasma thromboplastin antecedent (PTA) | Intrinsic | Endopeptidase |
| XII | Hageman factor | Intrinsic | Endopeptidase |
| XIII | Protransglutamidase, fibrin stabilizing factor (FSF), fibrinoligase | Both | Transpeptidase |

*Table adapted from M. W. King (2006) at med.unibs.it/~marchesi/blood.html

The generation of thrombin has historically been divided into three pathways, the intrinsic (suggesting that all components of the pathway are intrinsic to plasma) and extrinsic (suggesting that one or more components of the pathway are extrinsic to plasma) pathways that provide alternative routes for the generation of activated factor X (FXa), and the final common pathway which results in thrombin formation (FIG. 1). These pathways participate together in an interconnected and interdependent process to effect coagulation. A cell-based model of coagulation was developed that describes these pathways (FIG. 2) (Hoffman et al. (2001) Thromb Haemost 85:958-965). In this model, the "extrinsic" and "intrinsic" pathways are effected on different cell surfaces, the tissue factor (TF)-bearing cell and the platelet, respectively. The process of coagulation is separated into distinct phases, initiation, amplification and propagation, during which the extrinsic and intrinsic pathways function at various stages to produce the large burst of thrombin required to convert sufficient quantities of fibrinogen to fibrin for clot formation.

a. Initiation

FVII is considered to be the coagulation factor responsible for initiating the coagulation cascade, which initiation is dependent on its interaction with TF. TF is a transmembrane glycoprotein expressed by a variety of cells such as smooth muscle cells, fibroblasts, monocytes, lymphocytes, granulocytes, platelets and endothelial cells. Myeloid cells and endothelial cells only express TF when they are stimulated, such as by proinflammatory cytokines. Smooth muscle cells and fibroblasts, however, express TF constitutively. Accordingly, once these cells come in contact with the bloodstream following tissue injury, the coagulation cascade is rapidly initiated by the binding of TF with factor VII or FVIIa in the plasma.

As discussed below, the majority of FVII in the blood is in the zymogen form with a small amount, approximately 1%, present as FVIIa. In the absence of TF binding, however, even FVIIa has zymogen-like characteristics and does not display significant activity until it is complexed with TF. Thus, plasma FVII requires activation by proteolytic cleavage, and additional conformational change through interaction with TF, for full activity. A range of proteases, including factors IXa, Xa, XIIa, and thrombin, have been shown to be capable of FVII cleavage in vitro, a process which is accelerated in the presence of TF. FVIIa itself also can activate FVII in the presence of TF, a process termed autoactivation. The small amounts of FVIIa in the blood are likely due to activation by FXa and/or FIXa (Wildgoose et al. (1992) Blood 80:25-28, and Butenas et al. (1996) Biochemistry 35:1904-1910). TF/FVIIa complexes can thus be formed by the direct binding of FVIIa to TF, or by the binding of FVII to TF and then the subsequent activation of FVII to FVIIa by a plasma protease, such as FXa, FIXa, FXIa, or FVIIa itself. The TF/FVIIa complex remains anchored to the TF-bearing cell where it activates small amounts FX into FXa in what is known as the "extrinsic pathway" of coagulation.

The TF/FVIIa complex also cleaves small amounts of FIX into FIXa. FXa associates with its cofactor FVa to also form a complex on the TF-bearing cell that can then covert prothrombin to thrombin. The small amount of thrombin produced is, however, inadequate to support the required fibrin formation for complete clotting. Additionally, any active FXa and FIXa are inhibited in the circulation by antithrombin III (AT-III) and other serpins, which are discussed in more detail below. This would normally prevent clot formation in the circulation. In the presence of injury, however, damage to the vasculature results in platelet aggregation and activation at this site of thrombin formation, thereby allowing for amplification of the coagulation signal.

b. Amplification

Amplification takes place when thrombin binds to and activates the platelets. The activated platelets release FV from their alpha granules, which is activated by thrombin to FVa. Thrombin also releases and activates FVIII from the FVIII/vWF complex on the platelet membrane, and cleaves FXI into FXIa. These reactions generate activated platelets that have FVa, FVIIIa and FIXa on their surface, which set the stage for a large burst of thrombin generation during the propagation stage.

c. Propagation

Propagation of coagulation occurs on the surface of large numbers of platelets at the site of injury. As described above, the activated platelets have FXIa, FVIIIa and FVa on their surface. It is here that the extrinsic pathway is effected. FXIa activates FIX to FIXa, which can then bind with FVIIIa. This process, in addition to the small amounts of FIXa that is generated by cleavage of FIX by the TF/FVIIa complex on the TF-bearing cell, generates large numbers of FXIa/FVIIIa complexes which in turn can activate significant amounts of FX to FXa. The FXa molecules bind to FVa to generate the prothrombinase complexes that activate prothrombin to thrombin. Thrombin acts in a positive feedback loop to activate even more platelets and again initiates the processes described for the amplification phase.

Very shortly, there are sufficient numbers of activated platelets with the appropriate complexes to generate the burst of thrombin that is large enough to generate sufficient amounts of fibrin from fibrinogen to form a hemostatic fibrin clot. Fibrinogen is a dimer soluble in plasma which, when cleaved by thrombin, releases fibrinopeptide A and fibrinopeptide B. Fibrinopeptide B is then cleaved by thrombin, and the fibrin monomers formed by this second proteolytic cleavage spontaneously forms an insoluble gel. The polymerized fibrin is held together by noncovalent and electrostatic forces and is stabilized by the transamidating enzyme factor XIIIa (FXIIIa), produced by the cleavage of FXIII by thrombin. Thrombin also activates TAFI, which inhibits fibrinolysis by reducing plasmin generation at the clot surface. Additionally, thrombin itself is incorporated into the structure of the clot for further stabilization. These insoluble fibrin aggregates (clots), together with aggregated platelets (thrombi), block the damaged blood vessel and prevent further bleeding.

3. Regulation of Coagulation

During coagulation, the cascade is regulated by constitutive and stimulated processes to inhibit further clot formation. There are several reasons for such regulatory mechanisms. First, regulation is required to limit ischemia of tissues by fibrin clot formation. Second, regulation prevents widespread thrombosis by localizing the clot formation only to the site of tissue injury.

Regulation is achieved by the cations of several inhibitory molecules. For example, antithrombin III (AT-III) and tissue factor pathway inhibitor (TFPI) work constitutively to inhibit factors in the coagulation cascade. AT-III inhibits thrombin, FIXa, and FXa, whereas TFPI inhibits FXa and FVIIa/TF complex. An additional factor, Protein C, which is stimulated via platelet activation, regulates coagulation by proteolytic cleavage and inactivation of FVa and FVIIIa. Protein S enhances the activity of Protein C. Further, another factor which contributes to coagulation inhibition is the integral membrane protein thrombomodulin, which is produced by vascular endothelial cells and serves as a receptor for thrombin. Binding of thrombin to thrombomodulin inhibits thrombin procoagulant activities and also contributes to protein C activation.

Fibrinolysis, the breakdown of the fibrin clot, also provides a mechanism for regulating coagulation. The crosslinked fibrin multimers in a clot are broken down to soluble polypeptides by plasmin, a serine protease. Plasmin can be generated from its inactive precursor plasminogen and recruited to the site of a fibrin clot in two ways: by interaction with tissue plasminogen activator (tPA) at the surface of a fibrin clot, and by interaction with urokinase plasminogen activator (uPA) at a cell surface. The first mechanism appears to be the major one responsible for the dissolution of clots within blood vessels. The second, although capable of mediating clot dissolution, can play a major role in tissue remodeling, cell migration, and inflammation.

Clot dissolution also is regulated in two ways. First, efficient plasmin activation and fibrinolysis occur only in complexes formed at the clot surface or on a cell membrane, while proteins free in the blood are inefficient catalysts and are rapidly inactivated. Second, plasminogen activators and plasmin are inactivated by molecules such as plasminogen activator inhibitor type 1 (PAI-1) and PAI-2 which act on the plasminogen activators, and α2-antiplasmin and α2-macroglobulin that inactivate plasmin. Under normal circumstances, the timely balance between coagulation and fibrinolysis results in the efficient formation and clearing of clots following vascular injury, while simultaneously preventing unwanted thrombotic or bleeding episodes.

A summary of exemplary coagulation factors, cofactors and regulatory proteins, and their activities, are set forth in Table 4 below.

TABLE 4

Coagulation Factor Zymogens and Cofactors

| Name of Factor | Activity |
|---|---|
| *Zymogens of Serine Proteases* | |
| Factor XII | Binds exposed collagen at site of vessel wall injury, activated by high-MW kininogen and kallikrein |
| Factor XI | Activated by factor XIIa |
| Factor IX | Activated by factor XIa + $Ca^{2+}$ |
| Factor VII | Activated by thrombin, factor X, factor IXa or factor XIIa + $Ca^{2+}$, or autoactivation |
| Factor X | Activated on platelet surface by tenase complex (FIXa/FVIIIa); Also activated by factor VIIa + tissue factor + $Ca^{2+}$, or factor VIIa + $Ca^{2+}$ |
| Factor II | Activated on platelet surface by prothrombinase complex (FXa/FVa) |
| *Cofactors* | |
| Factor VIII | Activated by thrombin; factor VIIIa acts as cofactor for factor IXa in activation of factor X |
| Factor V | Activated by thrombin; factor Va acts as cofactor for factor Xa in activation of prothrombin |
| Factor III (Tissue factor) | Acts as cofactor for factor VIIa |
| | Fibrinogen |
| Factor I (Fibrinogen) | Cleaved by thrombin to form fibrin |
| | Transglutaminase |
| Factor XIII | Activated by thrombin + $Ca^{2+}$; promotes covalent cross-linking of fibrin |
| *Regulatory and other proteins* | |
| von Willebrand factor (vWF) | Acts as bridge between GPIb-V-IX complex and collagen |
| Protein C | Activated by thrombin bound to thrombomodulin; Ca degrades factors VIIIa and Va |
| Protein S | Acts as cofactor of protein C |
| Thrombomodulin | Endothelial cell surface protein; binds thrombin, which activates protein C |
| Antithrombin III | Coagulation inhibitor, primarily of thrombin and factor Xa, but also factors IXa, XIa, and XIIa, and factor VIIa complexed with TF |
| Tissue Factor Pathway Inhibitor (TFPI) | Binds FXa and then forms a quaternary structure with TF/FVIIa to inhibit TF/FVIIa activity |

*Table adapted from M. W. King (2006) at med.unibs.it/~marchesi/blood.html

C. Factor VII (FVII)

Factor VII is a vitamin K-dependent serine protease glycoprotein that is synthesized in animals, including mammals, as a single-chain zymogen in the liver and secreted into the blood stream. As described above, FVII is the coagulation protease responsible for initiating the cascade of proteolytic events that lead to thrombin generation and fibrin deposition. It is part of the extrinsic pathway, although the downstream effects of its activity also impact greatly on the intrinsic pathway. This integral role in clot formation has attracted significant interest in FVII as a target for clinical anti-coagulant and haemostatic therapies. For example, recombinant activated FVII (rFVIIa) has been developed as a haemostatic agent for use in hemophilic subjects, and subjects with other bleeding conditions. Provided herein are modified FVII polypeptides that are designed to have increased coagulation activity upon activation, and that can serve as improved therapeutics to treat diseases and conditions amenable to factor VII therapy.

1. FVII Structure and Organization

The human FVII gene (F7) is located on chromosome 13 at 13q34 and is 12.8 kb long with 9 exons. The FVII gene shares significant organizational similarity with genes coding for other vitamin-K dependent proteins, such as prothrombin, factor IX, factor X and protein C. The mRNA for FVII undergoes alternative splicing to produce two transcripts: variant 1 (Genbank Accession No. NM_000131, set forth in SEQ ID NO:81) and variant 2 (Genbank Accession No. NM_019616, set forth in SEQ ID NO:82). Transcript variant 2, which is the more abundant form in the liver, does not include exon 1b and thus encodes a shorter precursor polypeptide of 444 amino acids (FVII isoform b precursor; SEQ ID NO:2), compared with the 466 amino acid precursor polypeptide encoded by transcript variant 1 (FVII isoform a precursor; SEQ ID NO:1). The amino acids that are not present in the FVII isoform b precursor polypeptide correspond to amino acid positions 22 to 43 of the FVII isoform a precursor. These amino acids are part of the propeptide sequence, resulting in truncated FVII isoform b propeptide. The precursor polypeptides are made up of the following segments and domains: a hydrophobic signal peptide (aa 1-20 of SEQ ID NO:1 and 2), a propeptide (aa 21-60 of SEQ ID NO:1, and aa 21-38 of SEQ ID NO:2), a Gla domain (aa 39-83 of SEQ ID NO:2, and aa 61-105 of SEQ ID NO:1), a type B epidermal growth factor domain (EGF-like 1, aa 84-120 of SEQ ID NO:2, and aa 106-142 of SEQ ID NO:1), a type A epidermal growth factor domain (EGF-like 2, aa 125-166 of SEQ ID NO:2; and aa 147-188 of SEQ ID NO:1), and a serine protease domain (aa 191-430 of SEQ ID NO:2, and aa 213-452 of SEQ ID NO:1).

The 406 amino acid mature form of the FVII polypeptide (SEQ ID NO:3) lacks the signal peptide and propeptide sequences, and is identical in length and sequence regardless of the isoform precursor from which it originated. In the mature form of the FVII polypeptide the corresponding amino acid positions for the above mentioned domains are as follows: Gla domain (aa 1-45 of SEQ ID NO:3), EGF-like 1 (aa 46-82 of SEQ ID NO:3), EGF-like 2 (aa 87-128 of SEQ ID NO:3), and serine protease domain (aa 153-392 of SEQ ID NO:3).

The Gla domain of FVII is a membrane binding motif which, in the presence of calcium ions, interacts with phospholipid membranes that include phosphatidylserine. The Gla domain also plays a role in binding to the FVIIa cofactor, tissue factor (TF). Complexed with TF, the Gla domain of FVIIa is loaded with seven $Ca^{2+}$ ions, projects three hydrophobic side chains in the direction of the cell membrane for interaction with phospholipids on the cell surface, and has significant contact with the C-terminal domain of TF. The Gla domain is conserved among vitamin K-dependent proteins, such as prothrombin, coagulation factors VII, IX and X, proteins C, S, and Z. These proteins require vitamin K for the posttranslational synthesis of γ-carboxyglutamic acid, an amino acid clustered in the N-terminal Gla domain of these proteins. All glutamic residues present in the domain are potential carboxylation sites and many of them are therefore modified by carboxylation.

In addition to the Gla domain, the mature FVII protein also contains two EGF-like domains. The first EGF-like domain (EGF-like 1 or EGF1) is a calcium-binding EGF domain, in which six conserved core cysteines form three disulfide bridges. The EGF1 domain of FVII binds just one $Ca^{2+}$ ion, but with significantly higher affinity than that observed with the Gla domain (Banner et al. (1996) Nature 380:41-46). This bound $Ca^{2+}$ ion promotes the strong interaction between the EGF1 domain of FVII and TF (Osterlund et al. (2000) Eur J Biochem 267:6204-6211.) The second EGF-like domain (EGF-like 2 or EGF2) is not a calcium-binding domain, but also forms 3 disulphide bridges. Like the other domains in FVII, the EGF2 domain interacts with TF. It also is disulphide-bonded together with the protease domain, with which it shares a large contact interface.

Finally, the serine protease domain of FVII is the domain responsible for the proteolytic activity of FVIIa. The sequence of amino acids of FVII in its catalytic domain displays high sequence identity and tertiary structure similarity with other serine proteases such as trypsin and chymotrypsin (Jin et al. (2001) J Mol Biol, 307: 1503-1517). For example, these serine proteases share a common catalytic triad H57, D102, S195, based on chymotrypsin numbering. Unlike other serine proteases, however, cleavage of FVIIa is not sufficient to complete the conversion of the zymogen to a fully active enzyme. Instead, as discussed below, FVIIa is allosterically activated in its catalytic function by binding to the cell-surface receptor TF, which induces a conformational change in the FVIIa protease domain switching it from a zymogen-like inactive state to a catalytically active enzyme. A helix loop region between the cofactor binding site and the active site (i.e. amino acid residue positions 305-321, corresponding to residues 163-170i based on chymotrypsin numbering) of FVIIa is important for the allostery and zymogenicity of FVIIa (Persson et al. (2004) Biochem J., 379: 497-503). This region is composed of a short α helix (amino acid residue positions 307 to 312) followed by a loop. The N-terminal portion of the helix forms part of the interface between the protease domain and TF, and contains a number of residues that are important for proteolytic function and optimal binding to TF. A comparison of the crystal structure of FVIIa alone and FVIIa complexed with TF indicates that the α helix undergoes significant conformational change when FVIIa binds TF. The α helix of FVIIa alone appears distorted, shortened and oriented differently. This affects adjacent loop structures, moving them away from the active site. In contrast, the α helix of FVIIa when complexed with TF is stabilized, and the neighboring loops are positioned closer to the active site. This stabilization is effected through mechanisms that involve at least the methionine at amino acid position 306 (amino acid residue Met164 by chymotrypsin numbering) of FVII (Pike et al. (1999) PNAS 8925-8930).

2. Post-Translational Modifications

The FVII precursor polypeptide (either isoform of the Factor VII gene) is targeted to the cellular secretory pathway by the hydrophobic signal peptide, which inserts into the endoplasmic reticulum (ER) to initiate translocation across the membrane. While the protein is translocated through the ER membrane, the 20 amino acid signal peptide is cleaved off by a signal peptidase within the ER lumen, after which the polypeptide undergoes further post-translational modifications, including N- and O-glycosylation, vitamin K-dependent carboxylation of N-terminal glutamic acids to γ-carboxyglutamic acids, and hydroxylation of aspartic acid to β-hydroxyaspartic acid.

The propeptide provides a binding site for a vitamin K-dependent carboxylase which recognizes a 10-residue amphipathic α-helix in the FVII propeptide. After binding, the carboxylase γ-carboxylates 10 glutamic acid residues within the Gla domain of the FVII polypeptide, producing γ-carboxyglutamyl residues at positions E66, E67, E74, E76, E79, E80, E85, E86, E89 and E95 relative to the FVII precursor amino acid sequence set forth in SEQ ID NO:2. These positions correspond to positions E6, E7, E14, E19, E20, E25, E26, E29 and E35 of the mature FVII polypeptide set forth in SEQ ID NO:3. For optimal activity, the FVII molecule requires calcium, which binds the polypeptide and facilitates the conformational changes needed for binding of FVIIa with TF and lipids. The γ-carboxylated Gla domain binds seven $Ca^{2+}$ ions with variable affinity, which induces the conformational change that enables the Gla domain to interact with the C-terminal domain of TF, and also phosphatidylserines or other negatively charged phospholipids on the platelet membrane.

N-linked glycosylation is carried out by transfer of $Glc_3Man_9$ (GlcNAc) to two asparagine residues in the FVII polypeptide, at positions that correspond to amino acid residues 145 and 322 of the mature protein (SEQ ID NO:3). O-linked glycosylation occurs at amino acid residues 52 and 60 of the mature polypeptide, and hydroxylation to a β-hydroxyaspartic acid occurs at the aspartic acid residue at position 63. These O-glycosylated serine residues and the β-hydroxylated aspartic acid residue are in the EGF-1 domain of FVII. These modifications are effected in the ER and Golgi complex before final processing of the polypeptide to its mature form.

3. FVII Processing

The modified pro-FVII polypeptide is transported through the Golgi lumen to the trans-Golgi compartment where the propeptide is cleaved by a propeptidase just prior to secretion of the protein from the cell. PACE/furin (where PACE is an acronym for Paired basic Amino acid Cleaving Enzyme) is an endopeptidase localized to the Golgi membrane that cleaves many proteins on the carboxyterminal side of the sequence motif Arg-[any residue]-(Lys or Arg)-Arg. This propeptidase cleaves vitamin K-dependent glycoproteins such as the profactor IX and pro-vWF polypeptides (Himmelspach et al. (2000) Thromb Research 97; 51-67), releasing the propeptide from the mature protein. Inclusion of an appropriate PACE/furin recognition site into recombinant Factor VII precursors facilitates correct processing and secretion of the recombinant polypeptide (Margaritas et al. (2004) Clin Invest 113(7): 1025-1031). PACE/furin, or another subtilising-like propeptidase enzyme, is likely responsible for the proteolytic processing of pro-FVII to FVII. It can recognize and bind to the -Arg-Arg-Arg-Arg- consensus motif at amino acid positions 35-38 of the sequences set forth in SEQ ID NO:1, and positions 57-60 of the sequence set forth in SEQ ID NO:2, cleaving the propeptide and releasing the mature protein for secretion.

4. FVII Activation

The vast majority of FVII in the blood is in the form of an unactivated single-chain zymogen, although a small amount is present in a two-chain activated form. Activation of FVII occurs upon proteolytic cleavage of the $Arg^{152}$-$Ile^{153}$ bond (positions relative to the mature FVII polypeptide, set forth in SEQ ID NO:3), giving rise to a two-chain polypeptide containing a 152 amino acid light chain (approximately 20 kDa) linked by a disulphide bridge to a 254 amino acid heavy chain (approximately 30 kDa). The light chain of FVIIa contains the Gla domain and EGF-like domains, while the heavy chain contains the catalytic or serine-protease portion of the molecule. Conversion of the single chain FVII into the two-chain FVIIa is mediated by cleavage by FIXa, FXa, FXIIa, thrombin, or in an autocatalytic manner by endogenous FVIIa (Butenas et al. (1996) Biochem 35:1904-1910; Nakagaki et al. (1991) Biochem 30:10819-10824). The trace amount of FVIIa that does occur in circulation likely arises from the action of FXa and FIXa.

As discussed above, cleavage of FVII from its zymogen form to FVIIa is not sufficient for full activity. FVIIa requires association with TF for full activity (Higashi et al. (1996) J Biol Chem 271:26569-26574). Because of this requirement, FVIIa alone has been ascribed zymogen-like features, displaying zymogen folding and shape, and exhibiting relatively low activity. This zymogen-like characteristic of FVIIa in the absence of its association with TF makes it relatively resistant to antithrombin III (AT-III) and other serpins, which generally act primarily on the active forms of serine proteases rather than the zymogen form. In addition, TFPI, the principal inhibitor of TF/FVIIa activity, also does not bind efficiently to the "inactive" uncomplexed form of FVIIa.

Upon complexation with TF, FVIIa undergoes a conformational change that permits full activity of the molecule. All of the FVII domains are involved in the interaction with TF, but the conformational changes that occur are localized to the protease domain of FVIIa. For example, the conformational changes that occur in upon allosteric interaction of FVIIa and TF include the creation of an extended macromolecular substrate binding exosite. This extended binding site greatly enhances the FVII-mediated proteolytic activation of factor X.

The activity of FVIIa is further increased (i.e. a thousand-fold) when the interaction of FVIIa is with cell surface-expressed TF. This is because phospholipid membranes containing negatively-charged phospholipids, such as phosphatidylserine, are a site of interaction of other vitamin-K dependent coagulation factors such as FIX and FX, which bind via their Gla domains. Thus, the local concentration of these vitamin K-dependent proteins is high at the cell surface, promoting their interaction with the TF/FVIIa complex.

5. FVII Function

Although FVIIa exhibits increased activity following allosteric activation by TF, there is evidence that mechanisms exist in which FVIIa alone can initiate coagulation. Hence, FVII can function in a TF-dependent and a TF-independent manner. This latter pathway can play a much smaller role in normal hemostasis, although its significance could increase when it is considered in the context of bleeding disorders, and the treatment thereof.

a. Tissue Factor-Dependent FVIIa Activity

Circulating FVII binds cell-surface TF and is activated by FIXa, FXa, thrombin, or in an autocatalytic manner by endogenous FVIIa as described above. Alternatively, the very small amount of circulating FVIIa can directly bind TF. The TF/FVIIa complex then binds a small fraction of plasma FX and the FVIIa catalytic domain cleaves FX to produce FXa. Thrombin is thus formed via the extrinsic pathway on the surface of the TF-bearing cell, when FXa complexes with FVa and activates prothrombin to thrombin (FIG. 3). FIX also is activated by the TF/FVIIa complex, providing a link to the intrinsic pathway that operates on the surface of the activated platelet. The positive feedback systems in the coagulation cascade described above provide the means by which large amounts of thrombin are produced, which cleaves fibrinogen into fibrin to form a clot.

b. Tissue Factor-Independent FVIIa Activity

In addition to the TF-dependent mechanism for the activation of FX to FXa, there is evidence that FVIIa also can activate FX in the absence of TF. Activated platelets translocate phosphatidylserines and other negatively charged phospholipids to the outer, plasma-oriented surface. (Hemker et al. (1983) Blood Cells 9:303-317). These provide alternative "receptors" through which FVIIa can bind, albeit with a relatively low affinity that is 1000-fold less than the binding affinity of FVIIa to TF (Monroe et al. (1997) Br J Haematol 99:542-7). This interaction is mediated through residues in the Gla domain (Harvey et al. (2003) 278:8363-8369). FVIIa can then convert FX to FXa and FIX to FIXa on the activated platelet surface (Hoffman et al. (1998) Blood Coagul Fibrinolysis 9:S61-S65). The FXa remains associated with the platelet surface, where it can bind to FVa and generate sufficient thrombin from prothrombin, while the newly formed FIXa assembles with FVIIIa to catalyze the activation of more FX to FXa (FIG. 3). Hemostasis in the absence of TF can then achieved by the positive feedback and propagation mechanisms described above. It is notable, however, that while FVIIIa can contribute to the coagulation process on the activated platelet, its presence is not required for thrombin generation in the TF-independent mechanism (FIG. 3). Thus, in the absence of FVIII, such as in hemophilia patients, there is evidence that FVIIa can initiate and/or amplify thrombin generation through this secondary mechanism, and effect clot formation.

6. FVII as a Biopharmaceutical

FVII functions to initiate blood coagulation. Recombinant FVIIa (NovoSeven®; rFVIIa) is approved for treatment of bleeding episodes or prevention of bleeding in surgical or invasive procedures in patients having hemophilia A or B with inhibitors to Factor VIII or Factor IX, and in patients with congenital Factor VII deficiency. Novoseven® is a genetically engineered preparation of factor VIIa that is produced in a mammalian expression system using baby hamster kidney (BHK) cells. The agent is nearly identical to plasma-derived factor VIIa in its structure and function (Ratko et al. (2004), P & T, 29: 712-720).

Administration of recombinant FVIIa (rFVIIa) has been shown to promote blood clotting in patients suffering from hemophilia, and treatment with doses of FVIIa have been found to be safe and well-tolerated in human subjects. Typically, the use of rFVIIa has been in patients who have developed inhibitors (i.e. alloantibodies) to Factor VIII or Factor IX. The use of rFVIIa as a coagulant has been extended to treatment of other bleeding disorders, for example Glanzmann's thrombasthenia; other events associated with extensive bleeding, such as a result of trauma or surgery including, but not limited to, liver transplants, prostate surgery and hemorrhaging trauma; neonatal coagulophathies, severe hepatic disease; bone marrow transplantation, thrombocytopenias and platelet function disorders; urgent reversal of oral anticoagulation; congenital deficiencies of factors V, VII, X, and XI; and von Willebrand disease with inhibitors to von Willebrand factor.

A high-dose of rFVII is required to achieve a therapeutic effect. The dose and dosing regime required for rFVII administration varies depending on the clinical indication. For example, the typical dosage of rFVII for hemorrhagic episodes in patients with hemophilia A or hemophilia B having alloantibodies is 90 µg/kg administered by intravenous (IV) injection. Since rFVII has a half-life of 2 hours, repeat dosing is required. Additional dosing can be given every two hours until hemostasis is achieved. The dose range can be altered depending on the severity of the condition. For example, doses ranging from 35-120 µg/kg have been efficacious. Also, the dose and dosing regime can vary with other indications. For example, hemophilia A or hemophilia B patients undergoing surgery can be administered with an initial dose of 90 µg/kg immediately before surgery, with repeat dosing given every two hours during and following surgery. Depending on the severity of the surgery and bleeding episode, the bolus IV infusion can continue every two to six hours until healing is achieved. In congenital FVII deficient patients, rFVII is typically administered to prevent bleeding in surgery or other invasive procedures at 15-30 µg/kg every 4-6 hours until hemostasis is achieved.

The mechanism of action of rFVIIa to initiate hemostasis explains the high-dose requirement. Hemophilia patients have a normal initiation phase of coagulation, where the TF/FVIIa complex activates FX to FXa and leads to thrombin production at the site of the TF-bearing cell. Thereafter, however, the coagulation process breaks down as hemophilia patients lack FVIII (hemophilia A) or FIX (hemophilia B), and are therefore unable to form the FVIIIa/FIXa complexes on the surface of the activated platelet, which normally serve to activate large amounts of FX to FXa in the amplification and propagation phases described previously. Due to the presence of inhibitors, such as TFPI and AT-III, the FXa that is produced on the TF-bearing cell following cleavage by TF/FVIIa is unable to easily diffuse between cell surfaces. As a result, large-scale thrombin generation on the surface of the activated platelet does not occur, and a clot is not formed.

There is evidence that the hemostatic effect of high doses of rFVIIa can be achieved using TF-dependent and/or TF-independent generation of FXa by rFVIIa on the activated platelets (FIG. 3). TF-dependent thrombin generation can be maximized very quickly with the saturation of TF molecules with endogenous FVIIa and rFVIIa. In some instances, the high dose rFVIIa can bind activated platelets and convert FX to FXa. The surface-associated FXa activates FVa to generate sufficient thrombin for hemostasis. Since rFVII binds to the platelet surface with low affinity, a higher dose of rFVII can be required for thrombin generation. The activation of FXa on activated platelets ensures that rFVIIa-mediated hemostasis is localized to the site of injury.

A means to achieve reduced dosage of rFVII can improve its utility and efficiency as a drug. Provided herein are modified FVII polypeptides. Among these are modified FVII polypeptides that exhibit increased resistance to AT-III and increased catalytic activity in the presence and/or absence of TF. The modified FVII polypeptides provided herein also can exhibit increased resistance to TFPI, increased resistance to the inhibitory effects of $Zn^{2+}$, improved pharmacokinetic properties, such as increased serum half-life, increased binding and/or affinity for activated platelets, increased binding and/or affinity for serum albumin, and/or increased binding and/or affinity for platelet integrin $\alpha_{IIb}\beta_3$. These modified FVII polypeptides can exhibit increased coagulant activity. FVII polypeptides provided herein can be used in treatments to initiate hemostasis in a TF-dependent and/or a TF-independent mechanism such that FXa is produced and thrombin generated.

D. Modified FVII Polypeptides

Provided herein are modified FVII polypeptides. The FVII polypeptides exhibit alterations in one or more activities or properties compared to FVII polypeptide that is not so-modified. The activities or properties that can be altered as a result of modification include, but are not limited to, coagulation or coagulant activity; pro-coagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, factor X or factor IX; ability to bind to phospholipids; half-life; three-dimensional structure; pI; and/or conformation. Typically, the modified FVII polypeptides exhibit procoagulant activity. Provided herein are modified FVII polypeptides that exhibit increased coagulant activity upon activation from their single-chain zymogen form. Such modified FVII polypeptides can be used in the treatment of bleeding disorders or events, such as hemophilias or injury, where FVII polypeptides can function to promote blood coagulation. Included among such modified FVII polypeptides are those that have increased resistance to inhibitors such as antithrombin III (AT-III) and tissue factor pathway inhibitor (TFPI), those that have increased resistance to the inhibitory effects of $Zn^{2+}$, those that have increased catalytic activity in the presence and/or absence of TF, those that have improved pharmacokinetic properties, such as increased half-life, those that have increased binding and/or affinity for the platelet surface, those that have increased binding and/or affinity for serum albumin, and those that have increased binding and/or affinity for platelet integrin $\alpha_{IIb}\beta_3$. In particular, such modified FVII polypeptides can be used in diseases or conditions to provide coagulant activity while at the same time bypassing the requirements for FVIIIa and FIXa. In one example, modified FVII polypeptides provided herein can be used in hemophiliac patients having autoantibodies to FVIIIa and FIXa. Hence, the modified FVII polypeptides provided herein offer advantages including a decrease in the amount of administered FVII that is required to maintain a sufficient concentration of active FVII in the serum for hemostasis. This can lead to, for example, lower doses and/or dosage frequency necessary to achieve comparable biological effects, higher comfort and acceptance by subjects, and attenuation of secondary effects.

Modifications in a FVII polypeptide can be made to any form of a FVII polypeptide, including allelic and species variants, splice variants, variants known in the art, or hybrid or chimeric FVII molecules. For example, the modifications provided herein can be made in a precursor FVII polypeptide set forth in SEQ ID NOS:1 or 2, a mature FVII polypeptide set forth in SEQ ID NO:3, or any species, allelic or modified variants and active fragments thereof, that has 40%, 50%, 60%, 70%, 80%, 90%, 91%, 92%, 93%, 94%, 95%, 96%, 97%, 98%, or 99% sequence identity to any of the FVII polypeptides set forth in SEQ ID NOS:1-3. Allelic variants of FVII include, but are not limited to, any of those precursor polypeptides having a sequence of amino acids set forth in any of SEQ ID NOS:18-74. Exemplary species variants for modification herein include, but are not limited to, human and non-human polypeptides including FVII polypeptides from cow, mouse, pygmy chimpanzee, chimpanzee, rabbit, rat, rhesus macaque, pig, dog, zebra fish, pufferfish, chicken, orangutan and gorilla FVII polypeptides, whose sequences are set forth in SEQ ID NOS: 4-17 respectively. Modifications in a FVII polypeptide can be made to a FVII polypeptide that also contains other modifications, such as those described in the art, including modifications of the primary sequence and modifications not in the primary sequence of the polypeptide.

Modification of FVII polypeptides also include modification of polypeptides that are hybrids of different FVII polypeptides and also synthetic FVII polypeptides prepared recombinantly or synthesized or constructed by other methods known in the art based upon the sequence of known polypeptides. For example, based on alignment of FVII with other coagulation factor family members, such as factor IX (FIX) or factor X (FX), homologous domains among the family members are readily identified. Chimeric variants of FVII polypeptides can be constructed where one or more amino acids or entire domains are replaced in the FVII amino acid sequence using the amino acid sequence of the corresponding family member. Additionally, chimeric FVII polypeptides include those where one or more amino acids or entire domains are replaced in the human FVII amino acid sequence using the amino acid sequence of a different species (see, e.g., Williamson et al. (2005) J Thromb Haemost 3:1250-6). Such chimeric proteins can be used as the starting, unmodified FVII polypeptide herein.

Modifications provided herein of a starting, unmodified reference polypeptide include amino acid replacements or substitution, additions or deletions of amino acids, or any combination thereof. For example, modified FVII polypeptides include those with 1, 2, 3, 4, 5, 6, 7, 8, 9, 10, 11, 12, 13, 14, 15, 16, 17, 18, 19, 20, 30, 40, 50 or more modified positions. Also provided herein are modified FVII polypeptides with two or more modifications compared to a starting reference FVII polypeptide. Modified FVII polypeptides include those with 2, 3, 4, 5, 6, 7, 8, 9, 10, 11, 12, 13, 14, 15, 16, 17, 18, 19, 20, 30, 40, 50 or more modified positions. Any modification provided herein can be combined with any other modification known to one of skill in the art so long as the resulting modified FVII polypeptide exhibits increased coagulation activity when it is in its two-chain form. Typically, the modified FVII polypeptides exhibit increased coagulant activity. The activities or properties that can be altered as a result of modification include, but are not limited to, coagulation or coagulant activity; pro-coagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, tissue factor inhibitory factor (TFPI), antithrombin III, factor X or factor IX; ability to bind to phospholipids, serum albumin or platelet integrin $\alpha_{IIb}\beta_3$; serum half-life; three-dimensional structure; pI; and/or conformation. Included among the modified FVII polypeptides provided herein are those that have increased resistance to antithrombin III (AT-III), increased catalytic activity in the presence and/or absence of TF, increased resistance to tissue factor pathway inhibitor (TFPI), increased resistance to the inhibitory effects of $Zn^{2+}$, improved pharmacokinetic properties, such as increased serum half-life, increased intrinsic activity, altered glycosylation, increased affinity and/or binding for serum albumin, increased affinity and/or binding for platelet integrin $\alpha_{IIb}\beta_3$, and/or increased affinity and/or binding for activated platelets.

In some examples, a modification can affect two or more properties or activities of a FVII polypeptide. For example, a modification can result in increased AT-III resistance and increased catalytic activity of the modified FVII polypeptide compared to an unmodified FVII polypeptide. Modified FVII polypeptides provided herein can be assayed for each property and activity to identify the range of effects of a modification. Such assays are known in the art and described below. Modified FVII polypeptides provided herein also include FVII polypeptides that are additionally modified by the cellular machinery and include, for example, glycosylated, γ-carboxylated and β-hydroxylated polypeptides.

The modifications provided herein to a FVII polypeptide are made to increase AT-III resistance, increase TFPI resistance, increase resistance to the inhibitory effects of $Zn^{2+}$, improve pharmacokinetic properties, such as increase serum half-life, increase catalytic activity in the presence and/or absence of TF, increase binding to activated platelets, alter glycosylation, increase affinity and/or binding to platelet integrin $\alpha_{IIb}\beta_3$, increase affinity and/or binding to serum albumin, and/or increase affinity and/or binding for activated platelets. For example, a FVII polypeptide can include modification(s) that increase one or both of catalytic activity and binding to platelets. In other examples, any modification provided herein can be combined with any other modification known to one of skill in the art so long as the resulting modified FVII polypeptide exhibits increased coagulation activity when it is in its two-chain form. Typically, such increased coagulation activity is due to increased resistance to AT-III, increased catalytic activity, increased resistance to the inhibitory effects of $Zn^{2+}$, improved pharmacokinetic properties, such as increased serum half-life, increased resistance to TFPI, altered glycosylation, increased binding and/or affinity for phospholipids, increased binding and/or affinity for serum albumin, and/or increased binding and/or affinity for platelet integrin $\alpha_{IIb}\beta_3$. In some examples, modifications that are introduced into a FVII polypeptide to alter a specific activity or property also, or instead, can affect another activity or property. Thus, the modifications provided herein can affect the property or activity that they were designed to affect and one or more other properties or activities. For example, modifications made to a FVII polypeptide to increase catalytic activity also can increase AT-III resistance. In some examples, a single modification, such as single amino acid substitution, alters 2, 3, 4 or more properties or activities of a FVII polypeptide. Modified FVII polypeptides provided herein can be assayed for each property and activity to identify the range of effects of a modification. Such assays are known in the art and described below. Modified FVII polypeptides provided herein also include FVII polypeptides that are additionally modified by the cellular machinery and include, for example, glycosylated, γ-carboxylated and β-hydroxylated polypeptides.

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g., a kit, such as kit such as QuikChange available from Stratagene) of encoding nucleic acid molecules, or by solid phase polypeptide synthesis methods. In addition, modified chimeric proteins provided herein (i.e. Gla domain swap) can be generated by routine recombinant DNA techniques. For example, chimeric polypeptides can be generated using restriction enzymes and cloning methodologies for routine subcloning of the desired chimeric polypeptide components.

Other modifications that are or are not in the primary sequence of the polypeptide also can be included in a modified FVII polypeptide, or conjugate thereof, including, but not limited to, the addition of a carbohydrate moiety, the addition of a polyethylene glycol (PEG) moiety, the addition of an Fc domain, etc. For example, such additional modifications can be made to increase the stability or half-life of the protein.

The resulting modified FVII polypeptides include those that are single-chain zymogen polypeptide or those that are two-chain zymogen-like polypeptides. For example, any modified polypeptide provided herein that is a single-chain polypeptide can be autoactivated or activated by other coagulation factors to generate a modified FVII that is a two-chain form (i.e. FVIIa). The activities of a modified FVII polypeptide are typically exhibited in its two-chain form.

The modified FVII polypeptides provided herein can exhibit increased AT-III resistance, increased catalytic activity in the presence and/or absence of TF, increased resistance to the inhibitory effects of $Zn^{2+}$, increased TFPI resistance, improved pharmacokinetic properties, such as increased serum half-life, altered glycosylation, increased binding and/or affinity for phospholipids, increased binding and/or affinity for serum albumin, and/or increased binding and/or affinity for platelet integrin $\alpha_{IIb}\beta_3$. Typically, such properties and/or activities of the modified FVII polypeptides provided herein are made while retaining other FVII activities or properties, such as, but not limited to, binding to TF and/or binding and activation of FX. Hence, modified FVII polypeptides provided herein retain TF binding and/or FX binding and activation as compared to a wild-type or starting form of the FVII polypeptide. Typically, such activity is substantially unchanged (less than 1%, 5% or 10% changed) compared to a wild-type or starting protein. In other examples, the activity of a modified FVII polypeptide is increased or is decreased as compared to a wild-type or starting FVII polypeptide. Activity can be assessed in vitro or in vivo and can be compared to the unmodified FVII polypeptide, such as for example, the mature, wild-type native FVII polypeptide (SEQ ID NO:3), the wild-type precursor FVII polypeptide (SEQ ID NO:1 or 2), or any other FVII polypeptide known to one of skill in the art that is used as the starting material.

Hence, by virtue of the modifications provided herein, the modified FVII polypeptides can exhibit increased coagulant activity, increased duration of coagulant activity, and/or an enhanced therapeutic index. This can be observed in a TF-dependent and/or TF-independent manner. Typically, the increased coagulant activity, increased duration of coagulant activity, and/or an enhanced therapeutic index of the modified FVII polypeptides provided herein can be observed in vitro or ex vivo in appropriate assays, or in vivo, such as upon administration to a subject, such as a human or non-human subject. The increased activity of the modified FVII polypeptides can be increased by at least or about 1%, 2%, 3%, 4%, 5%, 6%, 7%, 8%, 9%, 10%, 20%, 30%, 40%, 50%, 60%, 70%, 80%, 90%, 100%, 110%, 120%, 130%, 140%, 150%, 160%, 170%, 180%, 190%, 200%, 300%; 400%, 500%, or more compared to the activity of the starting or unmodified FVIIa polypeptide.

1. Increased Catalytic Activity

FVII contains a serine residue (position 195 in standard chymotrypsin(ogen) numbering) in its active center that acts as a nucleophile during the cleavage reaction. The catalytic triad of serine proteases also includes two additional residues: H57 and D102 (chymotrypsin numbering). The catalytic triad of human FVIIa corresponds to H193, D242 and S344 of the mature FVII polypeptide set forth in SEQ ID NO:3. These three key amino acids each play an essential role in the catalytic activity of the proteases. Serine proteases hydrolyze peptide bonds via the formation of tetrahedral transition states and acyl-enzyme intermediates. The reaction pathway begins with non-covalent binding of the substrate into a groove on the surface of the protease (i.e., the active site cleft) that contains H57 and S195 to form a "Michaelis-Menton complex". Productive progress along the reaction pathway requires subsequent, nucleophilic attack of the P1 carbonyl residue of the substrate by the O-gamma of the active site serine (i.e., serine 195) of the enzyme to form a tetrahedral transition state that rapidly converts into an acyl-enzyme intermediate. A structure within the active site cleft that includes residues glycine 193 and serine 195 (corresponding to G342 and S344 of the mature FVII polypeptide set forth in SEQ ID NO:3) and is known as the oxyanion hole promotes efficient catalysis by stabilizing the transition state. Specifically, the main chain amide hydrogens of these two residues form stabilizing hydrogen bonds with the oxyanion (i.e., the carbonyl oxygen of the P1 residue) that is created in the tetrahedral transition state. In addition to this stabilization, binding of the substrate within the oxyanion hole positions the scissile bond properly for the productive acylation and deacylation reactions that result in bond cleavage. The importance of the oxyanion hole in FVII activity is highlighted by the observation that mutations at amino acid position 342 (corresponding to 193 by chymotrypsin numbering) can result in FVII deficiency (see e.g. Bernardi et al., (1994) Br. J. Haematol. 86:610-618 and Bernardi et al., (1996) Human Mut. 8:108-115).

a. Exemplary Modifications to Increase Catalytic Activity

Provided herein are modified FVII polypeptides that exhibit increased coagulant activity. Such FVII polypeptides can be generated by amino acid substitution of one or more residues that can affect the conformation of the oxyanion hole. The introduction of different amino acid residues at particular positions (e.g., position 143 by chymotrypsin numbering, or 286 by mature FVII numbering) can alter the conformation of the modified FVII polypeptide such that the oxyanion hole is more effective during catalysis. This can result in a modified FVII polypeptide with increased catalytic activity compared to an unmodified FVII polypeptide. Changes in catalytic activity due to mutations affecting the oxyanion hole can manifest as increased coagulant activity. Increases in catalytic and coagulant activity of the modified FVII polypeptides provided herein can be observed in the presence and/or absence of tissue factor (i.e. can be TF-dependent and/or TF-independent). Thus, when evaluated in an appropriate in vitro, in vivo, or ex vivo assay such as following administration to a subject as a pro-coagulant therapeutic, the modified FVII polypeptides can display increased coagulant activity compared with that of the unmodified FVII polypeptides.

The conformation of the oxyanion hole can be altered to induce a more effective conformation by modification of one or more amino acid residues that are involved in the formation of, or are in proximity to, the oxyanion hole. As provided herein, exemplary of such amino acid residues is Q286 (numbering corresponding a mature FVII polypeptide set forth in SEQ ID NO:3), which corresponds to Q143 by chymotrypsin numbering. Q286 can be modified by, for example, amino acid substitution, deletion or insertion. When the modification is effected by amino acid substitution, the glutamine residue at position 286 can be replaced with any other amino acid residue.

Q286 is located adjacent to and in contact with residues that form regions of the active site and active site cleft of the FVII polypeptide. As such, it has been stated that modification at this position should result in reduced catalytic activity (see e.g., U.S. Pat. No. 6,806,063). This has been demonstrated in previous studies (see, e.g., International Pat. Pub. No. WO2007031559), where the glutamine residue was replaced with an alanine (Q286A). The resulting modified FVIIa polypeptide exhibits a reduced ability to activate Factor X compared with the wild-type polypeptide. In other studies, the same mutation had essentially no effect on catalytic activity of the FVIIa mutant for Factor X (Dickinson et al., (1996) Proc. Nat. Acad. Sci. USA. 93:14379-14384) or a synthetic substrate (International Pat. Pub. No. WO2007031559).

As demonstrated herein (see Example 4 and below), however, modification of the FVII polypeptide at position 286 (numbering corresponding a mature FVII polypeptide set forth in SEQ ID NO:3; corresponding to position 143 by chymotrypsin numbering), particularly with a basic residue, such as arginine (Arg, R), results in a modified FVII polypeptide with increased catalytic and coagulant activity.

Thus, provided herein are modified FVII polypeptides that contain a modification, such as amino acid replacement with a basic amino acid, at the amino acid position corresponding to amino acid position 286 of a mature FVII polypeptide set forth in SEQ ID NO:3 (amino acid position 143 by chymotrypsin numbering). The modifications provided herein at amino acid position 286 can be made in any FVII polypeptide, including a precursor FVII polypeptide set forth in SEQ ID NOS:1 or 2, a mature FVII polypeptide set forth in SEQ ID NO:3, or any species, allelic or modified variants and active fragments thereof, that has 40%, 50%, 60%, 70%, 80%, 90%, 91%, 92%, 93%, 94%, 95%, 96%, 97%, 98%, or 99% sequence identity to any of the FVII polypeptides set forth in SEQ ID NOS:1-3.

Modification of a FVII polypeptide at amino acid position 286 by mature FVII numbering (corresponding to amino acid 143 by chymotrypsin numbering) can alter the conformation of the oxyanion hole to a conformation that facilitates more effective catalysis of a substrate. Increased catalytic activity of such modified FVII polypeptides can be exhibited in the presence and/or absence of tissue factor, and can be assessed using in vitro assays such as those described in Examples 4 and 7, below. In addition to exhibiting increased catalytic activity, FVII polypeptides that have been modified at amino acid position 286 by mature FVII numbering also can exhibit increased resistance to AT-III. This can be due to, for example, reduced binding of the modified FVII polypeptide to AT-III under specified conditions (e.g., following injection into a patient) or a reduced rate of inactivation by ATIII (i.e., a reduced second order rate constant for inhibition), which can manifest as increased coagulant activity in the presence of AT-III compared to an unmodified FVII polypeptide. Increased resistance to AT-III can be assessed using in vitro assays such as that described in Example 5.

Amino acid residue Q286 by mature FVII numbering (corresponding to Q143 by chymotrypsin numbering) can be modified by amino acid deletion, or replacement or substitution with any other amino acid. Alternatively, an amino acid can be inserted immediately before or after to alter the conformation in the vicinity of amino acid residue Q286. Further, a FVII polypeptide containing a modification of Q286 also can contain one or more other modifications, including amino acid insertions, deletions, substitutions or replacements, and modifications not in the primary sequence of the polypeptide, such as the addition of a carbohydrate moiety, the addition of a polyethylene glycol (PEG) moiety, the addition of an Fc domain, etc., or any combination thereof. Thus, a FVII polypeptide containing a modification at amino acid position 286 by mature FVII numbering can contain 2, 3, 4, 5, 6, 7, 8, 9, 10, 11, 12, 13, 14, 15, 16, 17, 18, 19, 20, 30, 40, 50 or more modified positions. Such polypeptides retain at least one activity of an unmodified FVII polypeptide. Typically, the modified FVII polypeptide exhibits increased coagulant activity.

These changes in activities can manifest as increased coagulant activity, increased duration of coagulant activity, increased onset of therapeutic benefit, increase onset of coagulant activity, and/or an enhanced therapeutic index. Thus, provided herein are modified FVII polypeptides containing a modification at amino acid position 286 by mature FVII numbering that exhibit increased coagulation activity compared to an unmodified FVII polypeptide. Such modified FVII polypeptides can be used in the treatment of bleeding disorders or events, such as hemophilias, surgery, trauma, and injury, where FVII polypeptides can function to promote blood coagulation. Because of an increased coagulant activity, the modified FVII polypeptides provided herein that contain a modification at amino acid position 286 by mature FVII numbering offer advantages over treatment with a wild-type FVII polypeptide, such as NovoSeven® Factor VII, including a decrease in the amount of administered FVII that is required to maintain a sufficient concentration of active FVII in the serum for hemostasis. This can lead to, for example, lower doses and/or dosage frequency necessary to achieve comparable biological effects, faster onset of therapeutic benefit, longer duration of action, higher comfort and acceptance by subjects, and/or attenuation of undesired secondary effects.

i. Basic Amino Acid Substitutions at Position 286

Provided are modified FVII polypeptides in which the glutamine at position 286 (numbering corresponding the mature FVII polypeptide set forth in SEQ ID NO:3; corresponding to position 143 by chymotrypsin numbering) is replaced with a basic amino acid residue, such as any one of arginine (Arg, R), histidine (His, H) or lysine (Lys, K). In particular, provided herein are modified FVII polypeptides in which the glutamine at position 286 is replaced with an arginine (i.e. Q286R, corresponding to Q143R by chymotrypsin numbering). Modeling studies indicate that substitution of the glutamine with an arginine results in the loss of two key interactions that stabilize an inactive conformation of the FVIIa oxyanion hole in wild-type or unmodified FVII. The destabilizing interactions in the wild-type or unmodified FVII polypeptide include the interaction between the sidechain of Q286 (corresponding to Q143 by chymotrypsin numbering) and the mainchain amide of G342 (corresponding to G193 by chymotrypsin numbering), and the interaction between the mainchain carbonyl of K341 (corresponding to K1 by chymotrypsin numbering) and the mainchain amide of S195 (corresponding to S344 by chymotrypsin numbering). By substituting the wild-type glutamine with an arginine at position 286, however, not only are these interactions lost, but two important new interactions are created. These include the creation of a salt bride between the basic sidechain of the modified amino acid R286 (R143 by chymotrypsin numbering) and the acidic sidechain of the native D289 (D146 by chymotrypsin numbering), and an interaction of the mainchain amide of the modified amino acid R286 and the mainchain carbonyl of K341 that stabilize an active conformation of the modified FVIIa polypeptide. Additionally, the new salt bridge between the modified amino acid R286 and D289 is expected to alter the conformation and/or flexibility of the "autolysis loop," which forms part of the active site cleft. The autolysis loop is involved in determining the macromolecular substrate and inhibitor specificity of coagulation proteases. Thus, an altered conformation and/or flexibility of this loop can result, for example, in increased catalytic activity for the substrate (e.g. factor X and/or factor IX) and increased resistance to inhibitors (e.g. TFPI and/or AT-III). Thus, modification of the glutamine at position 286 with a basic amino acid, such as arginine (Arg, R), histidine (His, H) or lysine (Lys, K), can result in increased catalytic and coagulant activity compared with the wild-type FVII polypeptide. Hence, provided herein are FVII polypeptides containing a Q286R, Q286K or Q286H mutation by mature FVII numbering (corresponding to Q143R, Q143K or Q143H, respectively, by chymotrypsin numbering). Exemplary of such polypeptides are those with a sequence of amino acids set forth in SEQ ID NOS:118, 119 and 129, respectively.

Amino acid replacement of the glutamine (Gln, Q) with a basic amino acid residue, in particular an arginine (Arg, R), at the amino acid position corresponding to amino acid position 286 of a mature FVII polypeptide set forth in SEQ ID NO:3 can be made in any FVII polypeptide, including a precursor FVII polypeptide with a sequence set forth in SEQ ID NOS:1 or 2, a mature FVII polypeptide set forth in SEQ ID NO:3, or any species, allelic and modified variant, such as those described in the art, and active fragments thereof, that has 40%, 50%, 60%, 70%, 80%, 90%, 91%, 92%, 93%, 94%, 95%, 96%, 97%, 98%, or 99% sequence identity to any of the FVII polypeptides set forth in SEQ ID NOS:1-3. For example, the Q286R mutation can be incorporated into any modified FVII polypeptide described in the art, including any of those described elsewhere herein. Such modified FVII polypeptides include, but are not limited to, a modified FVII polypeptide containing the mutation(s) M298Q (SEQ ID NO:158) see e.g. Persson et al., (2001) Proc. Nat. Acad. Sci. USA 98:13583-13588), E296V/M298Q (SEQ ID NO:343), V158E (SEQ ID NO:344), E296R/M298K (SEQ ID NO:345), K337A (SEQ ID NO:346), V158D/E296V/M298Q (SEQ ID NO:98; NN1731; see e.g., Persson et al., (2007) Art. Thromb. Vasc. Biol. 27(3): 683-689), V158D/E296V/M298Q/K337A (SEQ ID NO:347; see e.g. Lisman et al., (2003) J. Thromb. Haem. 1:2175-2178), V253N (SEQ ID NO:348; see e.g. U.S. Pat. No. 7,427,592), T106N (SEQ ID NO:349; see e.g. U.S. Pat. No. 7,427,592), T106N/V253N (SEQ ID NO:350; see e.g. U.S. Pat. No. 7,427,592), K143N/N145T (SEQ ID NO:351; U.S. Pat. No. 7,442,524), R315N/V317T (SEQ ID NO:352; U.S. Pat. No. 7,442,524) or K143N/N145T/R315N/V317T (SEQ ID NO:353; U.S. Pat. No. 7,442,524). The Q286R mutation also can be incorporated into chimeric FVII polypeptides or FVII fusion polypeptides, or FVII polypeptides that are otherwise modified, such as by glycoPEGylation (see e.g. WO2007022512, Ghosh et al., (2007) transcript of presentation at the Am. Society. Hematol. Meeting, Dec. 10, 2007). In one example, amino acid replacement of the glutamine with an arginine at the amino acid position corresponding to amino acid position 286 of a mature FVII polypeptide set forth in SEQ ID NO:3 results in a FVII polypeptide with a sequence of amino acids set forth in SEQ ID NO:118.

Provided herein are modified FVII polypeptides that contain the amino acid substitution Q286R by mature FVII numbering (corresponding to Q143R by chymotrypsin numbering), wherein the modified FVII polypeptides exhibit increased coagulant activity. Such modified FVII polypeptides can contain 1, 2, 3, 4, 5, 6, 7, 8, 9, 10, 11, 12, 13, 14, 15, 16, 17, 18, 19, 20, 30, 40, 50 or more modified positions, wherein one of the modified positions is amino acid position 286. Thus, provided herein are modified FVII polypeptides containing two or more modifications, wherein one modification is the amino acid substitution Q286R (by mature FVII numbering) and the modified FVII polypeptide exhibits increased coagulant activity compared to an unmodified FVII polypeptide. The Q286R mutation can be combined with any other mutation described herein or known in the art. Typically, the resulting modified polypeptide displays increased coagulant activity. One of skill in the art can determine the coagulant activity of a FVII polypeptide containing the Q286R modification using in vitro and in vivo assays well known in the art and described herein. The modified FVII polypeptides provided herein include those that contain the Q286R mutation and also contain one or more mutations that, for example, increase resistance to antithrombin-III, increase activation of FX, increase activation of FIX, increase binding and/or affinity to phospholipids, increase affinity for tissue factor, increase intrinsic activity, increase TF-dependent activity, alters the conformation of the polypeptide to alter zymogenicity, increase catalytic or coagulant activity, such as by shifting the equilibrium between highly active and less active FVIIa conformations in favor of the highly active conformations, increase resistance to proteases, decrease glycosylation, increase glycosylation, reduce immunogenicity, increase stability, and/or facilitate chemical group linkage.

The increased coagulant activity of modified FVII polypeptides containing the amino acid substitution Q286R can be a result of an increase in catalytic activity. The increased catalytic activity can be observed in the presence and/or absence of tissue factor (TF). Thus, the increased catalytic activity can be TF-dependent and/or TF-independent. The catalytic activity of a modified FVII polypeptide containing the Q286R mutation can be assessed using in vitro assays, such as the assays described in Examples 4 and 7. Such assays can determine the catalytic activity of a modified FVII polypeptide for a substrate, such as factor X, in the presence or absence of tissue factor. Modified FVII polypeptides containing the Q286R mutations can exhibit increased catalytic activity of about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more in the presence and/or absence of tissue factor compared to the catalytic activity of unmodified or wild-type FVII polypeptide either in vivo or in vitro. For example, as demonstrated in Example 4, a FVIIa polypeptide containing the Q286R mutation (Q143R by chymotrypsin numbering) as the sole modification can exhibit catalytic activity for FX in the presence or absence of TF that is approximately two to four times greater than the catalytic activity exhibited by wild-type FVII. In other examples, a FVIIa polypeptide containing the Q286R and M298Q mutations can exhibit catalytic activity for FX in the presence of TF that is approximately three to four times greater than the catalytic activity exhibited by wild-type FVII, and can exhibit catalytic activity for FX in the abesence of TF that is approximately seven to twenty-six times greater than the catalytic activity exhibited by wild-type FVII.

Non-limiting examples of modified FVII polypeptides containing two or more modifications, wherein one modification is the amino acid substitution Q286R (by mature FVII numbering) and the modified FVII polypeptide exhibits increased catalytic activity toward FX in the presence and/or absence of tissue factor compared to an unmodified FVII polypeptide, are set forth in Table 5 and in Example 4, below. The sequence identifier (SEQ ID NO) is identified in which exemplary amino acid sequences of the modified FVII polypeptide are set forth. As discussed in greater detail in section D.6, below, the "Gla swap FIX" modification involves deletion of the endogenous FVII Gla domain by deleting amino acid residues A1 to Y44 (residues corresponding to a mature FVII polypeptide set forth in SEQ ID NO:3) and insertion of 45 amino acid residues that correspond to amino acid residues Y1 to Y45 of the FIX Gla domain set forth in SEQ ID NO:83. In some examples, the heterologous FIX Gla domain in the "Gla swap FIX"-modified FVII polypeptide contains one or more amino acid substitutions at amino acid positions corresponding to M19, E40, K43 and/or Q44 of the FIX Gla domain set forth in SEQ ID NO:83. Such substitutions are denoted by curly brackets (e.g. {Gla swap FIX/Q44S}). In instances where a modified amino acid position does not have a corresponding chymotrypsin number (i.e. is not within amino acid positions 153 to 406 corresponding to a mature FVII polypeptide set forth in SEQ ID NO:3, and is not set forth in Table 1, above), the position is denoted in brackets using mature FVII numbering. For example, T158N does not have a corresponding chymotrypsin number and is set forth as T[158]N when referring to chymotrypsin numbering.

TABLE 5

| Modification - mature FVII numbering | Modification - chymotrypsin numbering | SEQ ID NO |
|---|---|---|
| Gla Swap FIX/Q286R | Gla Swap FIX/Q143R | 131 |
| Q286R/H257A | H117A/Q143R | 132 |
| S222A/Q286R | S82A/Q143R | 133 |

TABLE 5-continued

| Modification - mature FVII numbering | Modification - chymotrypsin numbering | SEQ ID NO |
|---|---|---|
| Q286R/S222A/H257A | S82A/H117A/Q143R | 134 |
| Gla Swap FIX/S222A/Q286R | S82A/Gla Swap FIX/Q143R | 135 |
| Gla Swap FIX/H257A/Q286R | H117A/Gla Swap FIX/Q143R | 136 |
| Gla Swap FIX/S222A/H257A/Q286R | Q143R/S82A/H117A/Gla Swap FIX | 137 |
| Q286R/M298Q | Q143R/M156Q | 138 |
| Q286R/M298Q/K341Q | Q143R/M156Q/K192Q | 139 |
| Q286R/M298Q/K199E | Q143R/M156Q/K60cE | 140 |
| S222A/H257A/Q286R/M298Q | S82A/H117A/Q143R/M156Q | 150 |
| A175S/Q286R/Q366V | A39S/Q143R/Q217V | 144 |
| S222A/Q286R/Q366V | S82A/Q143R/Q217V | 145 |
| H257S/Q286R | H117S/Q143R | 146 |
| H257S/Q286R/Q366V | H117S/Q143R/Q217V | 147 |
| S222A/H257A/Q286R/Q366V | S82A/H117A/Q143R/Q217V | 148 |
| Q286R/H373A | Q143R/H224A | 149 |
| Q286R/K341D | Q143R/K192D | 151 |
| Q286R/Q366D | Q143R/Q217D | 152 |
| Q286R/Q366N | Q143R/Q217N | 153 |
| Q286R/M298Q/Q366N | Q143R/M156Q/Q217N | 155 |
| Q286R/H373F | Q143R/H224F | 156 |
| Q286R/M298Q/H373F | Q143R/M156Q/H224F | 157 |
| Q286R/M298Q | Q143R/M156Q | 138 |
| T128N/P129A/Q286R | T[128]N/P[129]A/Q143R | 279 |
| Gla swap FIX/T128N/P129A/S222A/Q286R | Gla swap FIX/T[128]N/P[129]A/S82A/Q143R | 285 |
| Gla swap FIX/S52A/S60A/S222A/Q286R | Gla swap FIX/S[52]A/S[60]A/S82A/Q143R | 292 |
| Gla swap FIX/Q286R/M298Q | Gla swap FIX/Q143R/M156Q | 141 |
| T128N/P129A/Q286R/M298Q | T[128]N/P[129]A/Q143R/M156Q | 280 |
| Gla swap FIX/T128N/P129A/Q286R/M298Q | Gla swap FIX/T[128]N/P[129]A/Q143R/M156Q | 286 |
| {Gla swap FIX/E40L}/Q286R/M298Q | {Gla swap FIX/E[40]L}/Q143R/M156Q | 274 |
| {Gla swap FIX/K43I}/Q286R/M298Q | {Gla swap FIX/K[43]I}/Q143R/M156Q | 275 |
| {Gla swap FIX/Q44S}/Q286R/M298Q | {Gla swap FIX/Q[44]S}/Q143R/M156Q | 276 |
| {Gla swap FIX/M19K}/Q286R/M298Q | {Gla swap FIX/M[19]K}/Q143R/M156Q | 277 |
| S52A/S60A/Q286R/M298Q | S[52]A/S[60]A/Q143R/M156Q | 293 |
| T128N/P129A/S222A/H257A/Q286R/M298Q | T[128]N/P[129]A/S82A/H117A/Q143R/M156Q | 287 |
| S52A/S60A/S222A/H257A/Q286R/M298Q | S[52]A/S[60]A/S82A/H117A/Q143R/M156Q | 298 |
| T128N/P129A/Q286R/H373F | T[128]N/P[129]A/Q143R/H224F | 281 |
| S52A/S60A/Q286R/H373F | S[52]A/S[60]A/Q143R/H224F | 296 |
| T128N/P129A/Q286R/M298Q/H373F | T[128]N/P[129]A/Q143R/M156Q/H224F | 288 |
| S52A/S60A/Q286R/M298Q/H373F | S[52]A/S[60]A/Q143R/M156Q/H224F | 297 |
| V21D/Q143R/E154V/M156Q | V21D/Q143R/E154V/M156Q | 282 |
| Gla swap FIX/S222A/T239V/Q286R | Gla swap FIX/S82A/T99V/Q143R | 301 |
| T239V/Q286R/M298Q | T99V/Q143R/M156Q | 302 |
| Gla swap FIX/T239V/Q286R/M298Q | Gla swap FIX/T99V/Q143R/M156Q | 304 |
| S222A/T239V/H257A/Q286R/M298Q | S82A/T99V/H117A/Q143R/M156Q | 303 |
| T239V/Q286R/H373F | T99V/Q143R/H224F | 305 |
| T239V/Q286R/M298Q/H373F | T99V/Q143R/M156Q/H224F | 306 |
| T239I/Q286R | T99I/Q143R | 308 |
| GlaSwapFIX/S222A/T239I/Q286R | Gla swap FIX/S82A/T99I/Q143R | 310 |
| T239I/Q286R/M298Q | T99I/Q143R/M156Q | 311 |
| Gla swap FIX/T239I/Q286R/M298Q | Gla swap FIX/T99I/Q143R/M156Q | 313 |
| S222A/T239I/H257A/Q286R/M298Q | S82A/T99I/H117A/Q143R/M156Q | 312 |
| T239I/Q286R/H373F | T99I/Q143R/H224F | 314 |
| T239V/Q286R | T99V/Q143R | 299 |
| T239I/Q286R/M298Q/H373F | T99I/Q143R/M156Q/H224F | 315 |
| H257S/Q286R/M298Q | H117S/Q143R/M156Q | 322 |
| Gla swap FIX/Q286R/S222A/H257S | Gla swap FIX/Q143R/S82A/H117S | 321 |
| S222A/H257S/Q286R/M298Q | S82A/H117S/Q143R/M156Q | 324 |
| H257S/Q286R/M298Q/H373F | H117S/Q143R/M156Q/H224F | 325 |
| S222A/Q286R/M298Q/H373F | S82A/Q143R/M156Q/H224F | 326 |
| Gla swap FIX/S222A/Q286R/M298Q/H373F | Gla swap FIX S82A/Q143R/M156Q/H224F | 318 |
| S222A/Q286R/M298Q | S82A/Q143R/M156Q | 328 |
| Gla swap FIX/S222A/Q286R/M298Q | Gla swap FIX S82A/Q143R/M156Q | 317 |
| Gla swap FIX/S222A/Q286R/H373F | Gla swap FIX/S82A/Q143R/H224F | 316 |
| H257A/Q286R/M298Q | H117A/Q143R/M156Q | 321 |
| T128N/P129A/A175S/Q286R/M298Q | T[128]N/P[129]A/A39S/Q143R/M156Q | 337 |
| A122N/G124S/A175S/Q286R/M298Q | A[122]N/G[124]S/A39S/Q143R/M156Q | 338 |
| T128N/P129A/A175S/S222A/H257A/Q286R/M298Q | T[128]N/P[129]A/A39S/S82A/H117A/Q143R/M156Q | 339 |
| A122N/G124S/A175S/S222A/H257A/Q286R/M298Q | A[122]N/G[124]S/A39S/S82A/H117A/Q143R/M156Q | 340 |
| T128N/P129A/A175S/Q286R/M298Q/H373F | T[128]N/P[129]A/A39S/Q143R/M156Q/H224F | 341 |
| A122N/G124S/A175S/Q286R/M298Q/H373F | A[122]N/G[124]S/A39S/Q143R/M156Q/H224F | 342 |
| V158D/Q286R/E296V/M298Q/H373F | V21D/Q143R/E154V/M156Q/H224F | 320 |
| {Gla Swap FIX/K43I}/ T128N/P129A/Q286R/M298Q | {Gla Swap FIX/K[43]I}/ T[128]N/P[129]A/Q143R/M156Q | 355 |
| T128N/P129A/Q286R/M298Q/Q366N | T[128]N/P[129]A/Q143R/M156Q/Q217N | 356 |
| {Gla Swap FIX/K43I}/Q286R/M298Q/Q366N | {Gla Swap FIX/K[43]I}/Q143R/M156QQ217N | 357 |
| {Gla Swap FIX/K43I}/ T128N/P129A/Q286R/M298Q/Q366N | {Gla Swap FIX/K[43]I}/ T[128]N/P[129]A/Q143R/M156QQ217N | 358 |

TABLE 5-continued

| Modification - mature FVII numbering | Modification - chymotrypsin numbering | SEQ ID NO |
|---|---|---|
| V158D/Q286R/E296V/M298Q | V21D/Q143R/E154V/M156Q | 360 |
| T128N/P129A/Q286R/M298Q/Q366N/H373F | T[128]N/P[129]A/Q143R/M156Q/Q217N/H224F | 364 |
| T239V/Q286R/M298Q/Q366N | T99V/Q143R/M156Q/Q217N | 365 |
| T239I/Q286R/M298Q/Q366N | T99I/Q143R/M156Q/Q217N | 366 |
| T128N/P129A/T239V/Q286R/M298Q | T[128]N/P[129]A/T99V/Q143R/M156Q | 367 |
| T128N/P129A/S222A/T239V/H257A/Q286R/M298Q | T[128]N/P[129]A/S82A/T99V/H117A/Q143R/M156Q | 368 |
| T128N/P129A/T239V/Q286R/M298Q/H373F | T[128]N/P[129]A/T99V/Q143R/M156Q/H224F | 369 |
| T128N/P129A/T239I/Q286R/M298Q | T[128]N/P[129]A/T99I/Q143R/M156Q | 370 |
| T128N/P129A/T239I/Q286R/M298Q/H373F | T[128]N/P[129]A/T99I/Q143R/M156Q/H224F | 371 |

A FVII polypeptide containing the Q286R mutation by mature FVII numbering also can exhibit increased resistance to AT-III. The increased resistance to AT-III can be a result of a decreased rate of inhibition by AT-III or decreased binding to AT-III under specified conditions, such as following injection into an animal or patient. Resistance to AT-III can be demonstrated by measuring the second order rate constant for inhibition of wild type and variant FVIIa polypeptides. Other in vitro methods, such as BIAcore® assays, can also be used. The modified FVII polypeptides can exhibit increased resistance to the inhibitory effects of AT-III compared to an unmodified FVII polypeptide, which can be assessed in in vitro assays such as those described in Example 5. Modified FVII polypeptides containing the Q286R mutations can exhibit increased resistance to AT-III of about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the resistance to AT-III of unmodified or wild-type FVII polypeptide either in vivo or in vitro. For example, as demonstrated in Example 5 below, a FVIIa polypeptide containing the Q286R mutation (Q143R by chymotrypsin numbering) can exhibit catalytic activity for FX in the presence of AT-III and the absence of TF that is two to four times or more greater than the catalytic activity exhibited by wild-type FVII. Thus, the modified Q286R FVII polypeptide can exhibit an increase in resistance to AT-III of about 200% to 400% of that of an unmodified FVII polypeptide.

Increased catalytic activity and increased resistance to AT-III can manifest as increased coagulant activity in the presence and/or absence of TF. Such activities can be assessed in vitro, ex vivo or in vivo, such as by administration to a human or animal subject. The coagulation activity of the modified FVII polypeptides containing the Q286R mutation can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro. For example, Example 6.B.2 demonstrates that a FVIIa polypeptide containing the Q286R mutation (Q143R by chymotrypsin numbering) exhibits coagulation activity in a mouse bleeding model that is greater (approximately 2 fold) than the coagulation activity exhibited by a wild-type FVII polypeptide (e.g. NovoSeven® FVII). FVIIa polypeptide containing the Q286R and M298Q mutations (Q143R and M156Q, respectively, by chymotrypsin numbering) exhibit even greater coagulation activity.

ii. Other Mutations at Position 286

The glutamine at the amino acid position corresponding to position 286 of the FVII polypeptide set forth in SEQ ID NO:3 can be replaced with an amino acid other than a basic amino acid (i.e. other than arginine, histidine or lysine). Such substitutions can alter the conformation of the oxyanion hole, for example, resulting in a conformation that increases the catalytic activity of the modified FVII polypeptide compared to a wildtype FVII polypeptide. Modified FVII polypeptides that have an altered oxyanion hole conformation can exhibit increased catalytic activity of about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the catalytic activity of unmodified or wild-type FVII polypeptide when measured using either in vivo, ex vivo, or in vitro assays.

Table 6 provides non-limiting examples of exemplary amino acid replacements at Q286 other than replacement with arginine, corresponding to amino acid positions of a mature FVII polypeptide as set forth in SEQ ID NO:3. As noted, such FVII polypeptides are designed to change the conformation of the oxyanion hole to a more effective conformation, and therefore have increased coagulant activity. In reference to such mutations, the first amino acid (one-letter abbreviation) corresponds to the amino acid that is replaced, the number corresponds to the position in the mature FVII polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 6 below, the sequence identifier (SEQ ID NO) is identified in which exemplary amino acid sequences of the modified FVII polypeptide are set forth.

TABLE 6

| Modification - mature FVII numbering | Modification - chymotrypsin numbering | SEQ ID NO |
|---|---|---|
| Q286N | Q143N | 113 |
| Q286E | Q143E | 114 |
| Q286D | Q143D | 115 |
| Q286S | Q143S | 116 |
| Q286T | Q143T | 117 |
| Q286A | Q143A | 120 |
| Q286V | Q143V | 121 |
| Q286M | Q143M | 122 |
| Q286L | Q143L | 123 |
| Q286Y | Q143Y | 124 |
| Q286G | Q143G | 125 |
| Q286F | Q143F | 126 |
| Q286I | Q143I | 127 |
| Q286P | Q143P | 128 |
| Q286W | Q143W | 130 |

Modified FVII polypeptides that have an altered oxyanion hole conformation can exhibit increased catalytic activity of about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the catalytic activity of unmodified or wild-type FVII polypeptide when measured using either in vivo, ex vivo, or in vitro assays. In some examples, the modified FVII polypeptides that have an altered oxyanion hole conformation also can exhibit increased resistance to endogenous protease inhibitors (i.e., decreased rate of inhibition by or decreased affinity for inhibitors) such as TFPI or AT-III by about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the rate of inhibition by or affinity for endogenous inhibitors exhibited by unmodified or wild-type FVII polypeptide either in vivo, ex vivo, or in vitro. Increased catalytic activity and/or resistance to endogenous inhibitors such as AT-III resistance of such modified FVII polypeptides also can be manifested as increased coagulation activity, duration of coagulant activity, faster initiation of coagulant activity and/or enhanced therapeutic index. For example, the coagulation activity of the modified FVII polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo, ex vivo, or in vitro.

2. Increased Resistance to AT-III

Antithrombin III (also known as antithrombin or AT-III) is an important anticoagulant serpin (serine protease inhibitor). AT-III is synthesized as a precursor protein containing 464 amino acid residues (SEQ ID NO:122). In the course of secretion a 32 residue signal peptide is cleaved to generate a 432 amino acid mature human antithrombin (SEQ ID NO:123). The 58 kDa AT-III glycoprotein circulates in the blood and functions as a serine protease inhibitor (serpin) to inhibit a large number of serine proteases of the coagulation system. The principal targets of AT-III are thrombin and factor Xa, although AT-III also has been shown to inhibit the activities of FIXa, FXIa, FXIIa and, to a lesser extent, FVIIa. The action of AT-III is greatly enhanced by glycosaminoglycans, such as the naturally occurring heparan sulphate or the various tissue-derived heparins that are widely used as anticoagulants in clinical practice. AT-III binds in a highly specific manner to a unique pentasaccharide sequence in heparin that induces a conformational change in the reactive center loop. In such a conformation, the reactive center loop of AT-III can more efficiently interact with the reactive site of the serine protease, and effect inhibition.

AT-III is not normally inhibitory to free plasma FVIIa, even in the presence of heparin, likely due to the zymogen-like conformation of FVIIa that prevents efficient interaction with AT-III. The inhibitory effects of AT-III do increase, however, once FVIIa complexes with TF. Binding of AT-III to the TF/FVIIa complex can release FVIIa from TF and maintains it in an inactive complex with AT-III. The increased affinity of AT-III for TF-bound FVIIa compared with FVIIa alone presumably reflects the maturation of the active site of FVIIa when it is complexed with TF, therefore making it amenable to AT-III binding (Rao et al. (1993) Blood 81:2600-2607). Thus, the impact of AT-III on FVIIa is proportional to the intrinsic activity of the FVIIa molecule itself, unless mutations have been added to the FVIIa polypeptide that mediate resistance to AT-III. While FVIIa retains its zymogen-like conformation, AT-III has little effect. If, however, FVIIa changes conformation to a more active form, such as by binding TF, or by specific in vitro modifications, AT-III inhibition increases significantly. FVIIa polypeptides that are modified to have increased intrinsic activity often display simultaneous increases in susceptibility to AT-III inhibition. For example, modification of one or more amino acids in the activation pocket of FVIIa, such as by amino acid replacements corresponding to K337A, L305V, M298Q, V158D and E296V substitutions (relative to the mature FVII sequence set forth in SEQ ID NO:3), results in increased sensitivity of the FVIIa polypeptide to AT-III, thereby inhibiting FVIIa activity by up to 90% (Persson et al. (2001) PNAS 98:13583-13588). In another example, induction of a more zymogen-like conformation by modification of amino acids involved in the α-helix of FVIIa, while increasing the activity of the modified FVIIa protein, also increases its susceptibility to AT-III (Persson et al. (2004) Biochem J 379:497-503).

Exemplary Modifications to Effect Increased Resistance to AT-III

Modifications can be made to a FVII polypeptide that increase its resistance to AT-III. Generally, such modified FVII polypeptides retain at least one activity of a FVII polypeptide. Typically, such modifications include one or more amino acid substitutions at any position of the FVII polypeptide that are involved in the interaction of FVIIa with AT-III. Such modifications can, for example, result in reduced binding of the modified FVII to AT-III. The modified FVII polypeptides are therefore resistant to the naturally inhibitory effects of AT-III with respect to coagulation initiation. When evaluated in an appropriate in vitro assay, or in vivo, such as following administration to a subject as a pro-coagulant therapeutic, the modified AT-III-resistant FVII polypeptides display increased coagulant activity as compared with unmodified FVII polypeptides.

As described herein below, one of skill in the art can empirically or rationally design modified FVII polypeptides that display increased resistance to AT-III. Such modified FVII polypeptides can be tested in assays known to one of skill in the art to determine if such modified FVII polypeptides display increased resistance to AT-111. For example, such modified AT-III polypeptides can be tested for binding to AT-III. Generally, a modified FVII polypeptide that has increased resistance to AT-III will exhibit decreased binding and/or decreased affinity for AT-III. Typically, such assays are performed on a two-chain form of FVII, such as the activated form of FVII (FVIIa). Further, assays to determine effects of AT-III are generally performed in the presence of heparin and the presence of tissue factor, although such assays also can be performed in the absence of one or both cofactors.

Provided herein are modified FVII polypeptides exhibiting increased resistance to AT-III. Resistance to inhibition by ATIII is relevant both in the presence and absence of TF. FVII polypeptide variants provided herein have been modified at one or more of amino acid positions 239, 931, 366 and 373 (corresponding to amino acid positions 99, 170i, 217 and 224, respectively, by chymotrypsin numbering). These amino acid residues can be modified such as by amino acid replacement, deletion or substitution. The identified residues can be replaced or substituted with any another amino acid. Alternatively, amino acid insertions can be used to alter the conformation of a targeted amino acid residue or the protein structure in the vicinity of a targeted amino acid residue.

Any amino acid residue can be substituted for the endogenous amino acid residue at the identified positions. Typically, the replacement amino acid is chosen such that it interferes with the interaction between FVII and AT-III. In some examples, the threonine residue at position 239 (corresponding to position 99 by chymotrypsin numbering) is replaced with a serine (Ser, S), asparagine (Asn, N), glutamine (Gln, Q), valine (Val, V), leucine (Leu, L), histidine (His, H), or isoleucine (Ile, I). In other examples, the proline at position 321 (corresponding to position 170i by chymotrypsin numbering) is replaced with a lysine (Lys, K), glutamic acid (Glu, E), serine (Ser, S), or tyrosine (Tyr, Y). In further examples, the glutamine at position 366 (corresponding to position 217 by chymotrypsin numbering) is replaced with an asparagine (Asn, N), aspartic acid (Asp, D), glutamic acid (Glu, E), serine (Ser, S), threonine (Thr, T), lysine (Lys, K), or valine (Val, V). In other examples, the histidine at position 373 (corresponding to position 224 by chymotrypsin numbering) is replaced with an aspartic acid (Asp, D), glutamic acid (Glu, E), serine (Ser, S), phenylalanine (Phe, F) or alanine (Ala, A). In a further embodiment, combination mutants can be generated. Included among such combination mutants are those having two or more mutations of the residues T239, P321, Q366 and H373 (corresponding to T99, P170i, Q217 and H224, respectively, by chymotrypsin numbering). For example, a modified FVII polypeptide can possess amino acid substitutions at 2, 3, 4 or 5 of the identified positions. Hence, a modified polypeptide can display 1, 2, 3, 4 or 5 mutations that can result in increased resistance of the modified FVII polypeptide to the inhibitory effects of AT-III. For example, a FVII polypeptide can be modified at amino acid position 366 and amino acid position 373. In some example, the positions are modified by amino acid replacement, such as, for example, replacement of the glutamine at position 366 with an aspartic acid, and replacement of the histidine at position 373 with a glutamic acid.

Table 7 provides non-limiting examples of exemplary amino acid replacements at the identified residues, corresponding to amino acid positions of a mature FVII polypeptide as set forth in SEQ ID NO:3. Included amongst these are exemplary combination mutations. As noted, such FVII polypeptides are designed to increase resistance to AT-III and therefore have increased coagulant activity. In reference to such mutations, the first amino acid (one-letter abbreviation) corresponds to the amino acid that is replaced, the number corresponds to the position in the mature FVII polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 7 below, the sequence identifier (SEQ ID NO) is identified in which exemplary amino acid sequences of the modified FVII polypeptide are set forth.

TABLE 7

| Modification - mature FVII numbering | Modification - chymotrypsin numbering | SEQ ID NO |
|---|---|---|
| T239S | T99S | 159 |
| T239N | T99N | 160 |
| T239Q | T99Q | 161 |
| T239V | T99V | 162 |
| T239L | T99L | 163 |
| T239H | T99H | 164 |
| T239I | T99I | 165 |
| P321K | P170iK | 166 |
| P321E | P170iE | 167 |
| P321Y | P170iY | 168 |
| P321S | P170iS | 169 |
| Q366D | Q217D | 170 |
| Q366E | Q217E | 171 |
| Q366N | Q217N | 172 |
| Q366T | Q217T | 173 |
| Q366S | Q217S | 174 |
| Q366V | Q217V | 175 |
| Q366I | Q217I | 176 |
| Q366L | Q217L | 177 |
| Q366M | Q217M | 178 |
| H373D | H224D | 179 |
| H373E | H224E | 180 |

TABLE 7-continued

| Modification - mature FVII numbering | Modification - chymotrypsin numbering | SEQ ID NO |
|---|---|---|
| H373S | H224S | 181 |
| H373F | H224F | 182 |
| H373A | H224A | 183 |
| Q366D/H373E | Q217D/H224E | 184 |
| Q366V/H373V | Q217V/H224V | 185 |
| Q366V/H373L | Q217V/H224L | 186 |
| Q366V/H373I | Q217V/H224I | 187 |

Modified FVII polypeptides that have increased resistance for AT-III can exhibit a reduction in the extent of inhibition under specified conditions or in the second order rate constant for inhibition by AT-III by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the extent of inhibition or the second order rate constant for inhibition of unmodified or wild-type FVII polypeptide either in vivo or in vitro. Thus, the modified FVII polypeptides can exhibit increased resistance to AT-III that is at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more of the resistance exhibited by an unmodified FVII polypeptide. Increased resistance to AT-III by such modified FVII polypeptides also can be manifested as increased coagulation activity, duration of coagulation activity and/or enhanced therapeutic index in the presence of AT-III. The coagulation activity of the AT-III-modified FVII polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

3. Increased Resistance to Inhibition by $Zn^{2+}$

The amidolytic activity of FVIIa is regulated by allosteric alterations induced by binding of calcium ions and tissue factor (TF). Free FVII typically exists in an inactive conformation. Binding to $Ca^{2+}$ and TF induces a change in conformation and increased amidolytic activity (Pederson et al., (1990) J. Biol. Chem. 265:16786-16793). In contrast, the binding of zinc ions to FVIIa has been shown to have an inhibitory effect on activity. Binding of $Zn^{2+}$ to FVIIa results in decreased amidolytic activity and reduced affinity for TF. Studies indicate that $Ca^{2+}$ and $Zn^{2+}$ compete for binding to FVIIa, such that in the presence of $Ca^{2+}$, the inhibitory effect of $Zn^{2+}$ is reduced. Furthermore, FVIIa bound to TF is less susceptible to zinc inhibition.

In addition to the $Zn^{2+}$ binding sites in the Gla domain, the binding of which does not affect FVIIa amidolytic activity, two $Zn^{2+}$ binding sites have been mapped to the protease domain of FVII (Petersen et al., (2000) Protein Sci. 9:859-866, Bajaj et al., (2006) J. Biol. Chem. 281:24873-24888). Mapping of these binding sites in the protease domain indicates that the first $Zn^{2+}$ binding site involves the side chains of amino acid residues H216, E220 and S222 (H76, E80 and S82 by chymotrypsin numbering), and the second $Zn^{2+}$ binding site involves the side chains of amino acid residues H257, D219 and K161 (H117, D79 and K24 by chymotrypsin numbering).

$Zn^{2+}$ could, therefore, have a physiologic role in regulating homeostasis as a FVII inhibitor. It has been postulated that these inhibitory effects occur as a result of an increase in $Zn^{2+}$ concentration at the site of the clot following platelet activation (Bajaj et al., (2006) J. Biol. Chem. 281:24873-24888). Platelets store large amounts of $Zn^{2+}$ in the cytoplasm and α-granules, which are released upon platelet activation. This could increase the local concentration of $Zn^{2+}$ which in turn could inhibit FVIIa activity and FVIIa binding to TF.

Exemplary Modifications to Increase Resistance to Inhibition by $Zn^{2+}$

Provided herein are modified FVII polypeptides exhibiting increased resistance to the inhibitory effects of $Zn^{2+}$. This can be achieved, for example, by mutation of one or more residues in FVII involved in the interaction and binding with $Zn^{2+}$ to reduce or prevent such binding, thereby making the modified FVII polypeptides resistant to the inhibitory effects of $Zn^{2+}$ with respect to catalytic activity and TF binding. When evaluated in an appropriate in vitro assay, or in vivo, such as following administration to a subject as a pro-coagulant therapeutic, the modified FVII polypeptides can display increased coagulant activity as compared with unmodified FVII polypeptides.

Provided herein are modified FVII polypeptides having one or more mutations in residues that may be involved in $Zn^{2+}$ binding in the protease domain. Such residues include, but are not limited to, K161, H216, D219, E220, S222 and H257, with numbering relative to the amino acid positions of a mature FVII polypeptide set forth in SEQ ID NO:3 (corresponding to K24, H76, D79, E80, S82 and H117, respectively, by chymotrypsin numbering). In some examples, one or more of the amino acid residues H216, S222 and H257 (corresponding to H76, S82 and H117, respectively, by chymotrypsin numbering) are modified, such as by amino acid replacement or deletion. Any amino acid residue can be used to replace the endogenous residue at the identified positions. For example, provided herein are modified FVII polypeptides in which the histidine at amino acid position 216 is replaced with a serine, alanine, lysine or arginine residue. In another example, the serine at amino acid position 222 is replaced with an alanine or lysine residue, or the histidine at position 257 is replaced with an alanine or serine residue. In a further embodiment, the lysine at position 161 is replaced with a serine, alanine or valine residue. Modifications also include amino acid insertions at or near the amino acid positions identified as being involved in $Zn^{2+}$ binding. Such insertions can disrupt the $Zn^{2+}$ binding site, resulting in a modified FVII polypeptide with decreased binding to $Zn^{2+}$.

Combination mutants in which amino acid replacements are made at more than one of the above-identified residues in a FVII polypeptide also can be generated. Included among such combination mutants are those having two or more mutations of the residues K161, H216, D219, E220, S222 and H257 (corresponding to K24, H76, D79, E80, S82 and H117, respectively, by chymotrypsin numbering). For example, a modified FVII polypeptide can possess amino acid substitutions at 2, 3, 4, 5 or 6 of the identified positions. Hence, a modified polypeptide can display 1, 2, 3, 4, 5 or 6 mutations that can result in decreased ability of the modified FVII polypeptide to bind $Zn^{2+}$. For example, a FVII polypeptide can be modified by amino acid replacement of the serine at position 222 with a lysine, and the histidine at position 257 with an alanine residue.

The modified FVII polypeptides that have increased resistance to the inhibitory effects of $Zn^{2+}$ can exhibit an increase by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the resistance of unmodified or wild-type FVII polypeptide either in vivo or in vitro. A reduction in $Zn^{2+}$ binding and, therefore, increased resistance against the inhibitory effects of $Zn^{2+}$, by such modified FVII polypeptides also can be manifested as increased coagulation activity in the presence of $Zn^{2+}$. The coagulation activity of the modified FVII polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

Table 8 provides non-limiting examples of exemplary amino acid replacements at the identified residues, corresponding to amino acid positions of a mature FVII polypeptide as set forth in SEQ ID NO:3. Included amongst these are exemplary combination mutations. As noted, such FVII polypeptides are designed to exhibit reduced ability to bind $Zn^{2+}$ and, therefore, increased resistance against the inhibitory effects of $Zn^{2+}$. Thus, the modified FVII polypeptide can have increased coagulant activity. In reference to such mutations, the first amino acid (one-letter abbreviation) corresponds to the amino acid that is replaced, the number corresponds to the position in the mature FVII polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 8 below, the sequence identifier (SEQ ID NO) is identified in which exemplary amino acid sequences of the modified FVII polypeptide are set forth.

TABLE 8

| Modification - mature FVII numbering | Modification - chymotrypsin numbering | SEQ ID NO |
|---|---|---|
| K161S | K24S | 188 |
| K161A | K24A | 189 |
| K161V | K24V | 190 |
| H216S | H76S | 191 |
| H216A | H76A | 192 |
| H216K | H76K | 193 |
| H216R | H76R | 194 |
| S222A | S82A | 195 |
| S222K | S82K | 196 |
| S222V | S82V | 197 |
| S222N | S82N | 198 |
| S222E | S82E | 199 |
| S222D | S82D | 200 |
| H257A | H117A | 201 |
| H257S | H117S | 202 |
| S222K/H257A | S82K/H117A | 203 |
| H216A/H257A | H76A/H117A | 204 |
| H216A/S222A | H76A/S82A | 205 |

4. Altered Glycosylation

The properties and activities of a protein can be altered by modulating the extent, level, and/or type of glycosylation. For example, glycosylation can increase serum-half-life of polypeptides by increasing the stability, solubility, and reducing the immunogenicity of a protein. Glycosylation can increase the stability of proteins by reducing the proteolysis of the protein and can protect the protein from thermal degradation, exposure to denaturing agents, damage by oxygen free radicals, and changes in pH. Glycosylation also can allow the target protein to evade clearance mechanisms that can involve binding to other proteins, including cell surface receptors. Carbohydrate moieties that contain sialic acid can affect the solubility of a protein. The sialic acid moieties are highly hydrophilic and can shield hydrophobic residues of the target protein. This decreases aggregation and precipitation of the target protein. Decreased aggregation also aids in the prevention of the immune response against the target protein. Carbohydrates can furthermore shield immunogenic sequences from the immune system. The volume of space occupied by the carbohydrate moieties can decrease the available surface area that is surveyed by the immune system. These properties lead to the reduction in immunogenicity of the target protein.

Glycosylation sites provide a site for attachment of monosaccharides and oligosaccharides to a polypeptide via a glycosidic linkage, such that when the polypeptide is produced in a eukaryotic cell capable of glycosylation, it is glycosylated. The two main types of glycosylation are N-linked glycosylation, where the sugar units are attached via the amide nitrogen of an asparagine residue, and O-linked glycosylation, where the sugar units are attached via the hydroxyl group of serine, threonine, hydroxylysine or hydroxyproline residues. Other more minor forms of glycosidic linkages include S-linkage to cysteine and C-linkage to tryptophan. N-linked glycosylation occurs at asparagines in the consensus sequence -Asn-Xaa-Ser/Thr/Cys where Xaa is not proline. There is no known motif for O-glycosylation, although O-glycosylation is more probable in sequences with a high proportion of serine, threonine and proline residues. The presence of a potential glycosylation site does not, however, ensure that the site will be glycosylated during post-translational processing in the ER. Furthermore, the level of glycosylation may vary at a given site, and one site may have many different glycan structures. There are four naturally occurring glycosylation sites in FVII; two N-glycosylation sites at N145 and N322, and two O-glycosylation sites at S52 and S60, corresponding to amino acid positions in the mature FVII polypeptide set forth in SEQ ID NO:3.

Exemplary Modifications to Alter Glycosylation

Provided herein are FVII polypeptides that have been modified by altering the level and/or type of glycosylation as compared to an unmodified FVII polypeptide. Glycosylation can be increased or decreased compared to the unmodified FVII. In some instances, the level of glycosylation is increased, resulting in a hyperglycosylated FVII polypeptide. This can be achieved, for example, by incorporation of at least one non-native glycosylation site not found in the unmodified FVII polypeptide to which a carbohydrate moiety is linked. Hyperglycosylated FVII polypeptides also can be generated by linkage of a carbohydrate moiety to at least one native glycosylation site found but not glycosylated in the unmodified FVII polypeptide. In other examples, the level of glycosylation in a modified FVII polypeptide is decreased compared to an unmodified FVII polypeptide. This can be achieved by eliminating one or more native glycosylation sites, such as by amino acid replacement or deletion. One or more of the amino acid residues at amino acid positions 52, 60, 145 and 322 corresponding to a mature FVII polypeptide set forth in SEQ ID NO:3 can be deleted or can be replaced with an amino acid residue that can not be linked to carbohydrate moieties. For example, the serine residues at positions 52 and/or 60 can be replaced with an alanine residue, thereby eliminating one or both of the native O-glycosylation sites. Thus, glycosylation sites in a FVII polypeptide can be introduced, altered, eliminated or rearranged.

A FVII polypeptide can be modified at one or more positions to alter glycosylation of the polypeptide. The modified FVII polypeptides provided herein that have altered glycosylation compared to an unmodified FVII polypeptide can have no glycosylation, O-linked glycosylation, N-linked glycosylation, and/or a combination thereof. In some examples, a modified FVII polypeptide includes 1, 2, 3, 4, 5 or more carbohydrate moieties, each linked to different glycosylation sites. The glycosylation sites can be a native glycosylation site and/or a non-native glycosylation site. In some examples, the modified FVII polypeptide is glycosylated at more than one non-native glycosylation site. For example, a modified FVII polypeptide can be modified to introduce 1, 2, 3, 4, 5 or more non-native glycosylation sites.

Non-native glycosylation sites can be introduced by amino acid replacement. O-glycosylation sites can be created, for example, by amino acid replacement of a native residue with a serine or threonine. N-glycosylation sites can be created by establishing the motif Asn-Xaa-Ser/Thr/Cys, where Xaa is not proline. Creation of this consensus sequence by amino acid modification could involve replacement of a native amino acid residue with an asparagine, replacement of a native amino acid residue with a serine, threonine or cysteine, or replacement of a native amino acid residue with an asparagine and amino acid replacement of native residue with a serine, threonine or cysteine. For example, the lysine at position 109 (based on numbering of a mature FVII set forth in SEQ ID NO:3) can be replaced with an asparagine to create a new Asn-Xaa-Ser motif in the EGF1 domain and a new N-glycosylation site at amino acid position 109. In another example, the alanine at position 292 is replaced with an asparagine and the alanine position 294 is replaced with a serine to create a new Asn-Xaa-Ser motif and a new N-glycosylation site at amino acid position 292. In a further example, the alanine at position 175 is replaced with a serine to create a new Asn-Xaa-Ser motif at amino acid positions 173-175 based on numbering of a mature FVII set forth in SEQ ID NO:3, and a new N-glycosylation site at amino acid position 173. Non-native glycosylation sites can be created in any region in the FVII polypeptide. For example, one or more glycosylation sites can be introduced into the EGF1 domain, which corresponds to amino acid positions 46-82 of the mature FVII polypeptide in SEQ ID NO:3. In other examples, non-native glycosylation sites are introduced into the protease domain region of the FVII polypeptide, or in positions that can associate with the protease domain region upon protein folding.

Native glycosylation sites can be modified to prevent glycosylation or enhance or decrease glycosylation, while other positions in the FVII polypeptide can be modified to introduce non-native glycosylation sites. In some examples, the carbohydrate content of the FVII polypeptide can be modified. For example, the number position, bond strength, structure and composition of the carbohydrate linkages (i.e., structure of the carbohydrate based on the nature of the glycosidic linkages or branches of the carbohydrate) of carbohydrate moieties added to the FVII polypeptide can be altered.

The modified FVII polypeptides provided herein that have altered glycosylation retain at least one activity of FVII. Typically, the modified FVII polypeptides provided herein that have altered glycosylation exhibit increased coagulant activity compared to an unmodified FVII. In some examples, the level of glycosylation of a FVII polypeptide is increased. The level of glycosylation can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of unmodified or wild-type FVII polypeptide. In other examples, the level of glycosylation is decreased. The level of glycosylation can be decreased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of unmodified or wildtype FVII polypeptide. Altered glycosylation levels or changes in the type of glycosylation present on a modified FVII polypeptide compared to an unmodified FVII polypeptide can be manifested as increased coagulation activity. The coagulation activity of the modified FVII polypeptides with altered glycosylation can be increased by at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

Table 9 provides non-limiting examples of exemplary amino acid replacements, corresponding to amino acid positions of a mature FVII polypeptide as set forth in SEQ ID NO:3, that are included in a modified FVII polypeptide to alter glycosylation levels by adding or eliminating glycosylation sites. The exemplary amino acid replacements can create non-native glycosylation sites or eliminate native glycosylation sites. In some instances, two amino acid replacements are required to create a new glycosylation site. Also included in Table 9 are exemplary combination mutations that create more than one new non-native glycosylation site in the FVII polypeptide. As noted above, changes in glycosylation levels can, for example, increase half-life. Thus, the modified FVII polypeptides can have increased coagulant activity. In reference to such mutations, the first amino acid (one-letter abbreviation) corresponds to the amino acid that is replaced, the number corresponds to the position in the mature FVII polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme where appropriate. In instances where a modified amino acid position does not have a corresponding chymotrypsin number (i.e. is not within amino acid positions 153 to 406 corresponding to a mature FVII polypeptide set forth in SEQ ID NO:3, and is not set forth in Table 1, above), the position is denoted in brackets using mature FVII numbering. For example, A51N does not have a corresponding chymotrypsin number and is set forth as A[51]N when referring to chymotrypsin numbering. In Table 9 below, the sequence identifier (SEQ ID NO) is identified in which exemplary amino acid sequences of the modified FVII polypeptide are set forth. Also identified in Table 9 are any new non native glycosylation site(s) generated by the modification(s).

TABLE 9

| Modification(s) - mature FVII numbering | Modification(s) - chymotrypsin numbering | Non-native glycosylation site (mature FVII numbering) | Non-native glycosylation site (chymotrypsin numbering) | SEQ ID NO |
|---|---|---|---|---|
| S52A | S[52]A | none | none | 206 |
| S60A | S[60]A | none | none | 207 |
| E394N/P395A/R396S | E245N/P246A/R247S | N394 | N245 | 208 |
| R202S | R62S | N200 | N60d | 209 |
| A292N/A294S | A150N/A152S | N292 | N150 | 210 |
| G318N | G170fN | N318 | N170f | 211 |
| A175S | A39S | N173 | N37 | 212 |
| K109N | K[109]N | N109 | N[109] | 213 |
| A122N/G124S | A[122]N/G[124]S | N122 | N[122] | 214 |
| A51N | A[51]N | N51 | N[51] | 215 |
| T130N/E132S | T[130]N/E[132]S | N130 | N[130] | 216 |
| A122N/G124S/ E394N/P395A/R396S | A[122]N/G[124]S/ E245N/P246A/R247S | N122 and N394 | N[122] and N245 | 217 |
| A122N/G124S/ E394N/P395A/R396S/ G318N | A[122]N/G[124]S/ E245N/P246A/R247S/ G170fN | N122, N394 and N318 | N[122], N245 and N318 | 218 |
| S52A/S60A | S[52]A/S[60]A | none | none | 219 |
| S52N/P54S | S[52]N/P[54]S | N52 | N[52] | 220 |
| S119N/L121S | S[119]N/L[121]S | N119 | N[119] | 221 |
| T128N/P129A | T[128]N/P[129]A | N128 | N[128] | 222 |
| Q66N/Y68S | Q[66]N/Y[68]S | N66 | N[66] | 223 |
| S52N/P54S/A122N/G124S/ E394N/P395A/R396S | S[52]N/P[54]S/A[122]N/ G[124]S/E245N/P246A/ R247S | N52, N122 and N397 | N[52], N[122] and N245 | 224 |
| K109N/A292N/A294S | K[109]N/A150N/A152S | N109 and N292 | N[109] and N150 | 225 |
| K109N/A175S | K[109]N/A39S | N109 and N173 | N[109] and N37 | 226 |
| S119N/L121S/A175S | S[119]N/L[121]S/A39S | N119 and N173 | N[119] and N37 | 271 |
| T128N/P129A/A175S | T[128]N/P[129]A/A39A | N128 and N173 | N[128] and N37 | 272 |
| A122N/G124S/A175S | A[122]N/G[124]S/A39S | N122 and N173 | N[122] and N37 | 273 |

5. Increased Binding to Serum Albumin and/or Platelet Integrin $\alpha_{IIb}\beta_3$ Recombinant unmodified FVII has a serum half-life of only 1.5-3 hours in humans. Increasing the serum half-life of a FVII polypeptide can reduce in amount and frequency the dosages required for therapeutic effect. Several strategies can be employed to increase serum half-life including, but not limited to, increasing glycosylation, increasing protease resistance, PEGylation and conjugation or fusion to larger proteins, such as serum albumin and the Fc portion of IgG. Such modifications can result in, for example, reduced degradation of the FVII polypeptide by serum proteases, reduced renal clearance, reduced hepatic clearance, and reduced neutralization or clearance by the immune system. Another strategy that can be employed to increase the serum half-life of a FVII polypeptide involves the grafting of binding sequences into an unmodified FVII polypeptide to establish new or improved protein-protein interactions that are not observed in an unmodified FVII polypeptide.

Binding sequences that are inserted into the unmodified FVII polypeptide can contain about 5, 6, 7, 8, 9, 10, 11, 12, 13, 14, 15, 20, 25, 30 or more amino acid residues that facilitate interaction with another protein. The binding sequences can correspond to a binding sequence naturally present in a native protein, or can be a synthetic binding sequence with little or no sequence correlation to binding sequences naturally present in a native protein. The binding sequences used to modify the FVII polypeptides herein specifically interact with a binding site on another protein, establishing a non-covalent protein-protein interaction. In some examples, the protein for which the binding sequence is specific is a serum protein, such as, for example, serum albumin. Such sequences are well known in the art (see e.g. US20030069395, US20040009534, and US20070202045). In other examples, the protein recognized by the binding sequence is a cell surface receptor or ligand, such as, for example, platelet integrin $\alpha_{IIb}\beta_3$ (Smith et al. (1995) J. Biol. Chem. 270:30486-30490). The affinity with which the modified FVII polypeptide binds to the serum protein or cell surface receptor is typically characterized by a dissociation constant, Kd, of 1 µM, 100 nM, 10 nM, 1 nM, 100 pM, 10 pM, 1 pM or less. Binding of the modified FVII polypeptide to the serum protein or cell surface receptor via the binding sequence can reduce, for example, renal clearance or hepatic clearance of the modified FVII polypeptide compared to an unmodified FVII polypeptide. In some examples, binding of the modified FVII polypeptide to a cell surface receptor also can target the modified FVII polypeptide to a desired cell or tissue type or region in the body, thereby "concentrating" that FVII polypeptide at a particular site, such as, for example, a blood clot. Thus, modified FVII polypeptides containing engrafted binding sequences can exhibit increased half-life compared to an unmodified FVII polypeptide.

a. Exemplary FVII Polypeptides with Serum Albumin Binding Sequences

Provided herein are modified FVII polypeptides containing serum albumin binding sequences. The modified FVII polypeptides can bind serum albumin in vitro or in vivo, resulting in an increased half-life. Thus, provided herein are modified FVII polypeptides with increased half-life compared to an unmodified FVII polypeptide. When evaluated in an appropriate in vitro assay, or in vivo, such as following administration to a subject as a pro-coagulant therapeutic, the modified FVII polypeptides can display increased coagulant activity as compared with unmodified FVII polypeptides.

The modified FVII polypeptides provided herein can contain serum albumin binding sequences. The serum albumin binding sequences can be inserted within the unmodified FVII polypeptide or can be linked to the C- or N-terminal of the FVII polypeptide. For example, the serum albumin binding sequence can extend from the proline residue at amino acid position 406 at the C-terminus of the FVII polypeptide (corresponding to a mature FVII polypeptide set forth in SEQ ID NO:3). If the binding sequences are inserted within the FVII polypeptide, insertion is at a position such that the resulting modified FVII polypeptide retains at least one activity of an unmodified FVII polypeptide. The binding sequence can be inserted into the FVII polypeptide without removing any amino acid residues in the FVII polypeptide, or can replace one or more amino acid residues in the FVII polypeptide. In some examples, a serum albumin binding sequence replaces amino acid residues S103 to S111 (corresponding to a mature FVII polypeptide set forth in SEQ ID NO:3) to generate a modified FVII polypeptide. In other examples, a serum albumin binding sequence replaces amino acid residues H115 to S126, or T128 to P134 (corresponding to a mature FVII polypeptide set forth in SEQ ID NO:3). Exemplary serum albumin binding sequences are set forth in SEQ ID NOS: 206-212.

Table 10 provides non-limiting examples of exemplary modifications that can be made to a FVII polypeptide insert a serum albumin binding sequence. As noted above, inclusion of a serum albumin binding sequence can increase the half-life of a FVII polypeptide. Thus, the modified FVII polypeptides can have increased coagulant activity. In reference to the modifications listed in Table 10, the amino acid residues at which the serum albumin binding sequence is inserted in the FVII polypeptide, and the sequence of the binding sequence, are both represented in the table. For example, S103S111delinsQRLMEDICLPRWGCLWEDDF indicates that amino acid residues S103 through S111 of an unmodified FVII polypeptide full length numbering (residues corresponding to the mature FVII polypeptide sequence set forth in SEQ ID NO:3) have been deleted and replaced with a serum albumin binding sequence with the amino acid sequence QRLMEDICLPRWGCLWEDDF (SEQ ID NO:206). Recitation of just a single amino acid residue, such as P406, indicates that the serum albumin binding sequence is inserted after P406 and no amino acid residues have been deleted from the FVII polypeptide. The amino acid positions for mutation also are referred to by the chymotrypsin numbering scheme where appropriate. In instances where a modified amino acid position does not have a corresponding chymotrypsin number (i.e. is not within amino acid positions 153 to 406 corresponding to a mature FVII polypeptide set forth in SEQ ID NO:3, and is not set forth in Table 1, above), the position is denoted in brackets using mature FVII numbering. For example, S103 does not have a corresponding chymotrypsin number and is set forth as S[103] when referring to chymotrypsin numbering In Table 10 below, the sequence identifier (SEQ ID NO) is identified in which exemplary amino acid sequences of the modified FVII polypeptide are set forth.

TABLE 10

| Modification - mature FVII numbering | Modification - chymotrypsin numbering | SEQ ID NO |
|---|---|---|
| S103S111delinsQRLMEDICLPRWG CLWEDDF | S[103]S[111]delinsQRLMEDICLPRW GCLWEDDF | 227 |
| H115S126delinsQRLMEDICLPRWG CLWEDDF | H[115]S[126]delinsQRLMEDICLPRW GCLWEDDF | 228 |
| T128P134delinsQRLMEDICLPRWG CLWEDDF | T[128]P[134]delinsQRLMEDICLPRW GCLWEDDF | 229 |
| S103S111delinsIEDICLPRWGCLWE | S[103]S[111]delinsIEDICLPRWGCLWE | 230 |

TABLE 10-continued

| Modification - mature FVII numbering | Modification - chymotrypsin numbering | SEQ ID NO |
|---|---|---|
| H115S126delinsIEDICLPRWGCLWE | H[115]S[126]delinsIEDICLPRWGCLWE | 231 |
| T128P134delinsIEDICLPRWGCLWE | T[128]P[134]delinsIEDICLPRWGCLWE | 232 |
| S103S111delinsDICLPRWGCLWED | S[103]S[111]delinsDICLPRWGCLWED | 233 |
| H115S126delinsDICLPRWGCLWED | H[115]S[126]delinsDICLPRWGCLWED | 234 |
| T128P134delinsDICLPRWGCLWED | T[128]P[134]delinsDICLPRWGCLWED | 235 |
| P406insIEDICLPRWGCLW | P257insIEDICLPRWGCLW | 236 |
| P406insGGGSIEDICLPRWGCLW | P257insGGGSIEDICLPRWGCLW | 237 |
| P406insDICLPRWGCLWED | P257insDICLPRWGCLWED | 238 |
| P406insGGGSDICLPRWGCLWED | P257insGGGSDICLPRWGCLWED | 239 |

Modified FVII polypeptides containing a serum albumin binding sequence can exhibit increased binding to serum albumin that is at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the binding of unmodified or wild-type FVII polypeptide to serum albumin either in vivo or in vitro. Modified FVII polypeptides that can bind to serum albumin can exhibit increased serum half-life of at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the serum half-life of unmodified or wild-type FVII polypeptide either in vivo or in vitro. Increased serum albumin binding and/or increased serum half-life of such modified FVII polypeptides also can be manifested as increased coagulation activity, duration of coagulant activity and/or enhanced therapeutic index. The coagulation activity of the modified FVII polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

b. Exemplary FVII Polypeptides with Platelet Integrin $\alpha_{IIb}\beta_3$ Binding Sequences Provided herein are modified FVII polypeptides containing platelet integrin $\alpha_{IIb}\beta_3$ binding sequences. Platelet integrin $\alpha_{IIb}\beta_3$ (also called glycoprotein (GP) IIb/IIIa) is the most abundant platelet adhesion receptor. It is a calcium-dependent heterodimer that serves as a receptor for proteins including, but not limited to, fibrinogen, fibronectin, vitronectin, von Willebrand factor, and thrombospondin. Binding to "cognate" protein ligands can activate $\alpha_{IIb}\beta_3$ and induce signal transduction in the cytoplasm via the protein's intercellular domain. Modified FVII polypeptides containing platelet integrin $\alpha_{IIb}\beta_3$ binding sequences, therefore, can bind platelets. The modified FVII polypeptides can bind platelet integrin $\alpha_{IIb}\beta_3$ (the activated and/or unactivated form) in vitro or in vivo, resulting in an increased half-life. Those FVIIa variants that bind selectively to activated $\alpha_{IIb}\beta_3$ can, therefore, be targeted to activated platelets and thus concentrated at the site of an evolving blood clot. Selective targeting of FVIIa to evolving blood clots would be expected to improve the therapeutic utility of the variant by improving both efficacy and therapeutic index. Thus, provided herein are modified FVII polypeptides with increased half-life compared to an unmodified FVII polypeptide and variants that, in addition, bind selectively to activated platelets. When evaluated in an appropriate in vitro assay, or in vivo, such as following administration to a subject as a pro-coagulant therapeutic, the modified FVII polypeptides can display increased coagulant activity as compared with unmodified FVII polypeptides.

The modified FVII polypeptides provided herein contain platelet integrin $\alpha_{IIb}\beta_3$ binding sequences. Platelet integrin $\alpha_{IIb}\beta_3$ binding sequences can be inserted with the unmodified FVII polypeptide or can be linked to the C- or N-terminal of FVII polypeptide. For example, the $\alpha_{IIb}\beta_3$ binding sequences can extend from the proline residue at amino acid position 406 at the C-terminus of the FVII polypeptide (corresponding to a mature FVII polypeptide set forth in SEQ ID NO:3). If the binding sequences are inserted within the FVII polypeptide, insertion is at a position such that the resulting modified FVII polypeptide retains at least one activity of an unmodified FVII polypeptide. The binding sequence can be inserted into the FVII polypeptide without removing any amino acid residues in the FVII polypeptide, or can replace one or more amino acid residues in the FVII polypeptide. In some examples, a platelet integrin $\alpha_{IIb}\beta_3$ binding sequence replaces amino acid residues S103 to S111 (corresponding to a mature FVII polypeptide set forth in SEQ ID NO:3) to generate a modified FVII polypeptide. In other examples, an $\alpha_{IIb}\beta_3$ binding sequence replaces amino acid residues H115 to S126, or T128 to P134 (corresponding to a mature FVII polypeptide set forth in SEQ ID NO:3). Exemplary platelet integrin $\alpha_{IIb}\beta_3$ binding sequences are set forth in SEQ ID NOS: 213-215.

Table 11 provides non-limiting examples of exemplary modifications that can be made to a FVII polypeptide to insert a platelet integrin $\alpha_{IIb}\beta_3$ binding sequence. As noted above, inclusion of a platelet integrin $\alpha_{IIb}\beta_3$ binding sequence can increase the serum half-life of a FVII polypeptide and/or target the protein to an evolving blood clot. Thus, the modified FVII polypeptides can have increased coagulant activity. In reference to the modifications listed in Table 11, the amino acid residues at which the platelet integrin $\alpha_{IIb}\beta_3$ binding sequence is inserted in the FVII polypeptide, and the sequence of the binding sequence, are both represented in the table. For example, H115S126delinsSFGRGDIRNV indicates that amino acid residues H115 thru S126 of an unmodified FVII polypeptide full length numbering (residues corresponding to the mature FVII polypeptide sequence set forth in SEQ ID NO: 3) have been deleted, and replaced with an $\alpha_{IIb}\beta_3$ binding sequence with the amino acid sequence SFGRGDIRNV (SEQ ID NO:213). Recitation of just a single amino acid residue, such as P406, indicates that the $\alpha_{IIb}\beta_3$ binding sequence is inserted after P406 and no amino acid residues have been deleted from the FVII polypeptide. The amino acid positions for mutation also are referred to by the chymotrypsin numbering scheme where appropriate. In instances where a modified amino acid position does not have a corresponding chymotrypsin number (i.e. is not within amino acid positions 153 to 406 corresponding to a mature FVII polypeptide set forth in SEQ ID NO:3, and is not set forth in Table 1, above), the position is denoted in brackets using mature FVII numbering. For example, S103 does not have a corresponding chymotrypsin number and is set forth as S[103] when referring to chymotrypsin numbering. In Table 11 below, the sequence identifier (SEQ ID NO) is identified in which exemplary amino acid sequences of the modified FVII polypeptide are set forth.

TABLE 11

| Modification - mature FVII numbering | Modification - chymotrypsin numbering | SEQ ID NO |
|---|---|---|
| S103S111delinsSFGRGDIRNV | S[103]S[111]delinsSFGRGDIRNV | 240 |
| H115S126delinsSFGRGDIRNV | H[115]S[126]delinsSFGRGDIRNV | 241 |
| T128P134delinsSFGRGDIRNV | T[128]P[134]delinsSFGRGDIRNV | 242 |
| P406insCSFGRGDIRNVC | P257insCSFGRGDIRNVC | 243 |
| P406insGGGSCSFGRGDIRNVC | P257insGGGSCSFGRGDIRNVC | 244 |

Modified FVII polypeptides containing a platelet integrin $\alpha_{IIb}\beta_3$ binding sequence can exhibit increased binding to platelet integrin $\alpha_{IIb}\beta_3$ that is at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the binding of unmodified or wild-type FVII polypeptide to platelet integrin $\alpha_{IIb}\beta_3$ in vivo. Modified FVII polypeptides that can bind to platelets via platelet integrin $\alpha_{IIb}\beta_3$ can exhibit increased half-life of at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the half-life of unmodified or wild-type FVII polypeptide either in vitro, in vivo or ex vivo. Increased half-life of such modified FVII polypeptides also can be manifested as increased coagulation activity, duration of coagulant activity and/or enhanced therapeutic index. For example, the coagulation activity of the modified FVII polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

6. Modification by Introduction of a Heterologous Gla Domain

Interaction of residues in the γ-carboxylated Gla domain of vitamin K-dependent plasma proteins, such as FVII, FIX, FX, prothrombin, protein C and protein S, and negatively charged phospholipids on the membrane surface is important for hemostasis. The Gla domains of vitamin K-dependent plasma proteins typically contain approximately 45 amino acids, of which 9 to 12 glutamic acid residues are post-translationally modified by vitamin K-dependent carboxylation to form γ-carboxyglutamate (Gla). The amino acids that form the Gla domain are positioned immediately after those that form the signal peptide and propeptide of the proteins, and are therefore situated at the N-terminus following processing and cleavage of the precursor polypeptides to the mature proteins. For example, the amino acids that form the Gla domain in FVII are at positions 39-83 of the precursor polypeptide set forth in SEQ ID NO:1, positions 61-105 of the precursor polypeptide set forth in SEQ ID NO:2, and positions 1 to 45 of the mature polypeptide set forth in SEQ ID NO:3. Of these, the 10 glutamic acid residues at positions E6, E7, E14, E19, E20, E25, E26, E29 and E35 of the mature FVII polypeptide set forth in SEQ ID NO: 3 are modified by carboxylation to generate γ-carboxyglutamate (Gla) residues.

Due to its relatively low binding affinity for activated platelets, the Gla domain of FVII is a target for modification, with the aim of enhancing the interaction between the modified FVII and the phospholipid membrane, thereby increasing coagulation activity. Modification can be effected by substitution of specific amino acids that are involved in this interaction (see, e.g., Shah et al. PNAS 95: 4429-4234, Harvey et al. (2003) J Biol Chem 278:8363-8369). Alternatively, modification can be effected by substitution of the entire Gla domain with the Gla domain of another vitamin K-dependent protein i.e. Gla domain swap. This type of modification results in a chimeric protein, such as that which resulted when the Gla domain of protein C was replaced with the Gla domain of FVII (Geng et al. (1997) Thromb Haemost 77:926-933).

Typically, such modification includes introduction, such as by addition or substitution, of a heterologous Gla domain, or a sufficient portion thereof to effect phospholipids binding into a region of the FVII polypeptide to generate a chimeric modified FVII polypeptide. Generally, such a chimeric FVII polypeptide retains at least one activity of FVII. The binding and/or affinity of Gla-modified FVII polypeptides for activated platelets can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the binding and/or affinity of unmodified or wild-type FVII polypeptide either in vivo or in vitro. The binding and/or affinity for activated platelets by modified FVII polypeptides also can be manifested as increased coagulation activity. The coagulation activity of the Gla-modified FVII polypeptides can be increased by at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo or in vitro.

A Gla domain or sufficient portion thereof to effect phospholipid binding, such as 30%, 40%, 50%, 60%, 70%, 80%, 90%, 91%, 92%, 93%, 94%, 95%, 96%, 97%, 98%, 99% or more of the heterologous Gla domain, contained within any polypeptide can be used as a source of a heterologous Gla domain for introduction or replacement of a region of a FVII polypeptide. Typically, such a heterologous Gla domain exhibits binding affinity for phospholipids, for example, phospholipids present on the surface of an activated platelet. Generally, the choice of a heterologous Gla domain is one that exhibits higher affinity for phospholipids as compared to the affinity of the Gla domain of FVII. The exact Gla domain, or sufficient portion thereof, used as a heterologous domain for modification of a FVII polypeptide can be rationally or empirically determined. Exemplary of other Gla-containing polypeptides include, but are not limited to, FIX, FX, prothrombin, protein C, protein S, osteocalcin, matrix Gla protein, Growth-arrest-specific protein 6 (Gas6), and protein Z. The Gla domains of these exemplary proteins are set forth in any of SEQ ID NOS: 83-91. For example, 2, 3, 4, 5, 6, 7, 8, 9, 10, 20, 30, 40 or more contiguous amino acids, or the entire Gla domain, of a heterologous Gla domain can be introduced into a FVII polypeptide. In addition, introduction of the Gla domain into a FVII polypeptide also can include additional amino acids not part of the Gla domain of the heterologous polypeptide so long as the additional amino acids do not significantly weaken the phospholipid binding ability of the introduced Gla domain.

In some examples, the introduction is by addition of the Gla domain to the FVII polypeptide such that the heterologous Gla domain is inserted into the endogenous Gla domain or into another region or domain of the FVII polypeptide so long as the modified FVII polypeptide retains at least one activity of FVII. In such examples, the native Gla domain of the FVII polypeptide is retained in the polypeptide, although in some instances the amino acid sequence that makes up the native Gla domain is interrupted. In other examples, the heterologous Gla domain, or a sufficient portion thereof, is inserted adjacent to, either on the N- or C-terminus, of the native Gla domain such that the native Gla domain is not interrupted. In an additional example, the heterologous Gla domain, or a sufficient portion thereof, is inserted into another domain of the FVII polypeptide.

Also provided herein are modified Gla-domain FVII polypeptides where all or a contiguous portion of the endogenous Gla domain of FVII is removed and is replaced with a heterologous Gla domain, or a sufficient portion thereof to effect phospholipid binding, so long as the modified FVII polypeptide retains at least one activity of FVII. Such modification also is referred to as a Gla domain swap. Exemplary of Gla swap modifications are those in which the endogenous Gla domain is replaced with all or a portion of the Gla domain of any one of FIX (SEQ ID NO:83), FX (SEQ ID NO:84), thrombin (SEQ ID NO:85), Protein C (SEQ ID NO:86) or Protein S (SEQ ID NO:87). Such modifications are called "Gla Swap FIX," "Gla Swap FX," "Gla Swap Thrombin," "Gla Swap Prot C" and "Gla Swap Prot S," respectively. Such modified FVII polypeptides can exhibit increased binding to activated platelets, resulting in increased coagulant activity. The "Gla swap FIX" modification involves deletion of the endogenous FVII Gla domain by deleting amino acid residues A1 to Y44 (residues corresponding to a mature FVII polypeptide set forth in SEQ ID NO:3) and insertion of 45 amino acid residues that correspond to amino acid residues Y1 to Y45 of the FIX Gla domain set forth in SEQ ID NO:83. The Gla Swap FX modification involves deletion of amino acid residues A1 to Y44 (residues corresponding to a mature FVII polypeptide set forth in SEQ ID NO:3) and insertion of 44 amino acid residues that correspond to A1 to Y44 of the FX Gla domain set forth in SEQ ID NO:84. The Gla Swap Thrombin modification involves deletion of amino acid residues A1 to Y44 (residues corresponding to a mature FVII polypeptide set forth in SEQ ID NO:3) and insertion of 44 amino acid residues that correspond to amino acid residues Y1 to Y44 of the Thrombin Gla domain set forth in SEQ ID NO:85. The Gla Swap Protein C modification involves deletion of amino acid residues A1 to Y44 (residues corresponding to a mature FVII polypeptide set forth in SEQ ID NO:3) and insertion of 44 amino acid residues that correspond to amino acid residues A1 to H44 of the Protein C Gla domain set forth in SEQ ID NO:86. The Gla Swap Protein S modification involves deletion of amino acid residues A1 to Y44 (residues corresponding to a mature FVII polypeptide set forth in SEQ ID NO:3) and insertion of 44 amino acid residues that correspond to amino acid residues Y1 to Y44 of the Protein S Gla domain set forth in SEQ ID NO:87.

In some examples, modifications, including, but not limited to, amino acid substitutions or replacements, insertions and/or deletions, are made to the heterologous Gla domain that is being introduced into the FVII polypeptide. Such modifications can effect, for example, increased binding to activated platelets, due to increased phospholipid binding, as compared to the binding observed with the wild type form of the heterologous Gla domain. For example, if the Factor IX Gla domain, or a phospholipid binding portion thereof, is introduced into a FVII polypeptide to generate a modified FVII polypeptide, the Factor IX Gla domain can contain amino acid mutations that confer increased phospholipid binding compared to the wild-type Factor IX Gla domain. The heterologous Gla domain contained the modified FVII polypeptides provided herein can contain 1, 2, 3, 4, 5, 6, 7, 8, 9, 10 or more modifications, such as amino acid substitutions or replacements, insertions and/or deletions.

In some examples, the modification(s) in the heterologous Gla domain increase phospholipid binding. In other examples, the heterologous Gla domain can contain one or more mutations compared to the wild-type form of the heterologous Gla domain that confer FVII-like functions to the heterologous Gla domain. For example, as noted above, R36 of the FVII Gla domain set forth in SEQ ID NO:119 can be involved in interactions with FX. Hence, the heterologous Gla domain can contain further modifications, such as any required to maintain an arginine at position 36 of the mature FVII polypeptide, as set forth in SEQ ID NO:3, or any other modifications required to maintain FX-activation properties of the modified FVIIa polypeptide (Ruf et al. (1999) Biochem 38:1957-1966). Thus, in some examples, a corresponding mutation to R36 can be made in the heterologous Gla domain. The corresponding position can be determined by one of skill in the art, such as by alignment of amino acid sequences.

Provided herein are modified FVII polypeptides containing a Gla swap modification wherein the heterologous Gla domain, or phospholipid binding portion thereof, contains one or more mutations compared to the wild-type heterologous Gla domain, and is introduced into the FVII polypeptide by replacement of some or all of the endogenous FVII Gla domain. In one example, the modified FVII polypeptides provided herein contain a "Gla swap FIX" modification, which, as described above, involves deletion of the endogenous FVII Gla domain by deleting amino acid residues A1 to Y44 (residues corresponding to a mature FVII polypeptide set forth in SEQ ID NO:3) and insertion of 45 amino acid residues that correspond to amino acid residues Y1 to Y45 of the FIX Gla domain set forth in SEQ ID NO:83. The FIX Gla domain used in the Gla swap modification can contain one or more mutations compared to the wild type form of the FIX Gla domain set forth in SEQ ID NO:83, such as 1, 2, 3, 4, 5 or more mutations, such as amino acid substitutions, deletions or insertions. For example, the heterologous FIX Gla domain in the "Gla swap FIX" modified FVII polypeptide can contain one or more amino acid substitutions at amino acid positions corresponding to M19, E40, K43 and/or Q44 of the FIX Gla domain set forth in SEQ ID NO:83.

In one example, the FIX Gla domain contains a M19K amino acid substitution. Such a modification is denoted by {Gla Swap FIX/M19K} i.e. the methionine at the amino acid position corresponding to amino acid position 19 of the FIX Gla domain set forth in SEQ ID NO:83 is replaced with a lysine. In a further example, the modified heterologous FIX Gla domain in the modified FVII polypeptide contains a E40L amino acid substitution, denoted by {FIX Gla Swap/E40L}, whereby the glutamic acid at the amino acid position corresponding to amino acid position 40 of the FIX Gla domain set forth in SEQ ID NO:83 is replaced with a leucine. Also provided herein are modified FVII polypeptides that contain a K43I substitution (denoted by {Gla Swap FIX/

K43I}) wherein the lysine at the amino acid position corresponding to amino acid position 43 of the FIX Gla domain set forth in SEQ ID NO:83 is replaced with an isoleucine. In another example, the modified heterologous FIX Gla domain in the modified FVII polypeptide contains a Q44S amino acid substitution, denoted by {FIX Gla Swap/Q44S}, whereby the glutamine at the amino acid position corresponding to amino acid position 44 of the FIX Gla domain set forth in SEQ ID NO:83 is replaced with a serine. In one example, the heterologous FIX Gla domain contains the M19K/E40L/K43I/Q44S amino acid substitutions.

Modified FVII polypeptides containing a heterologous Gla domain, such as modified heterologous Gla domain, can exhibit increased coagulant activity at lower dosages as compared to a wild-type FVII molecule, such as NovoSeven®, due to increased binding and/or affinity for activated platelets. The coagulation activity of the Gla-modified FVII polypeptides can be increased by at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FVII polypeptide either in vivo, ex vivo or in vitro.

7. Combinations and Additional Modifications

Any one or more of the modifications described above can be combined with any other modification(s) described above or described elsewhere in the art. Thus, in addition to modification of FVII polypeptides to have increased resistance to AT-III, increased catalytic activity, increased resistance to inhibition by $Zn^{2+}$, altered glycosylation, improved pharmacokinetic properties, such as increased half-life, increased binding and/or affinity to serum albumin, increased binding and/or affinity to phospholipids, or increased binding and/or affinity for platelet integrin platelet integrin $\alpha_{IIb}\beta_3$, modified FVII polypeptides provided herein also include those that exhibit more than one of the above-noted properties. Typically, such additional modifications are those that themselves result in an increased coagulant activity of the modified polypeptide and/or increased stability of the polypeptide. Accordingly, the resulting modified FVII polypeptides exhibit an increased coagulant activity. The additional modifications can include, for example, any amino acid substitution, deletion or insertion known in the art, typically any that increases the coagulant activity and/or stability of the FVII polypeptide. Any modified FVII polypeptide provided herein can contain 1, 2, 3, 4, 5, 6, 7, 8, 9, 10, 11, 12, 13, 14, 15, 16, 17, 18, 19, 20 or more additional amino acid modifications, so long as the resulting modified FVII polypeptide retains a FVII activity of the wild-type or unmodified polypeptide.

In one example, the additional modification can be made to the FVII polypeptide sequence such that its interaction with other factors, molecules and proteins is altered. For example, the amino acid residues that are involved in the interaction with tissue factor pathway inhibitor (TFPI) can be replaced such that the affinity and/or binding of the modified FVII polypeptide to TF is decreased. Other modifications include, but are not limited to, modification of amino acids that are involved in interactions with factor X, factor IX, tissue factor (TF) and phospholipids. In some examples, the modification made to the FVII polypeptide sequence includes insertion of amino acids that constitute a binding sequence, such as, for example, a serum albumin binding sequence or a glycoprotein IIb-IIIa binding sequence.

Additional modifications also can be made to a modified FVII polypeptide provided herein that alter the conformation or folding of the polypeptide. These include, for example, the replacement of one or more amino acids with a cysteine such that a new disulphide bond is formed, or modifications that stabilize an α-helix conformation, thereby imparting increased activity to the modified FVII polypeptide.

Additional modifications also can be made to the FVII polypeptide to effect post-translational modifications. For example, the polypeptide can be modified to include additional glycosylation sites such that the resulting modified FVII polypeptide has increased glycosylation compared to an unmodified FVII polypeptide. Modifications also can be made to introduce amino acid residues that can be subsequently linked to a chemical moiety, such as one that acts to increase stability of the modified FVII polypeptide. The stability of a FVII polypeptide also can be altered by modifying potential proteolytic sites, thereby increasing the resistance of the modified FVII polypeptide to proteases.

Additionally, amino acids substitutions, deletions or insertions can be made in the endogenous Gla domain such that the modified FVII polypeptide displays increased binding and/or affinity for phospholipid membranes. Such modifications can include single amino acid substitution, deletions and/or insertions, or can include amino acid substitution, deletion or insertion of multiple amino acids. For example, all or part of the endogenous Gla domain can be replaced with all or part of a heterologous Gla domain. In other examples, the modified FVII polypeptides provided herein can display deletions in the endogenous Gla domain, or substitutions in the positions that are normally gamma-carboxylated (US20070037746).

The following sections describe non-limiting examples of exemplary modifications described in the art to effect increased stability and/or coagulant activity of a FVII polypeptide. As discussed above, such modifications also can be additionally included in any modified FVII polypeptide provided herein. The amino acid positions referenced below correspond to the mature FVII polypeptide as set forth in SEQ ID NO:3. Corresponding mutations can be made in other FVII polypeptides, such as allelic, species or splices variants of the mature FVII polypeptide set forth in SEQ ID NO:3.

a. Modifications that Increase Resistance to TFPI

In one example, additional modifications can be made to a modified FVII polypeptide that contains a modification at amino acid position 286 by mature FVII numbering that result in increased resistance to TFPI. Such resistance to TFPI can be achieved, for example, by mutation of one or more residues in FVII involved in the interaction and binding with TFPI to reduce or prevent such binding, thereby making the modified FVII polypeptides resistant to the naturally inhibitory effects of TFPI with respect to coagulation initiation. For example, the modifications can be made at amino acid residues that are FVII/TFPI contact residues or residues in close proximity to the interaction surface.

Examples of additional modifications that can be included in the modified FVII polypeptides provided herein to increase resistance to TFPI include, but are not limited to, those described in International Patent Publication No. WO2004/083361, Neuenschwander et al., (1995) Biochemistry 34:8701-8707, Chang et al., (1999) Biochemistry 38:10940-10948, and Iakhiaev et al., (2001) Thromb. Haemost. 85:458-463, and related application U.S. application Ser. No. 12/082,662. Non-limiting examples of exemplary amino acid modifications described in the art that can result in increased resistance to TFPI of the modified FVII polypeptide include any one or more of Q176, D196K, D196R, D196A, D196Y, D196F, D196W, D196L, D196I, K197Y, K197A, K197E, K197D, K197L, K197M, K197I, K197V, K197F, K197W, K199A, K199D, K199E, G237W, G237T, G237I, G237V, T239A, R290A, R290E, R290D, R290N, R290Q, R290K, R290M, R290V, K341E, K341R, K341Q, K341N, K341M, K341D, G237T238insA, G237T238insS, G237T238insV, G237T238insAS, G237T238insSA, D196K197insK, D196K197insR, D196K197insY, D196K197insW, D196K197insA, D196K197insM, K197I198insE, K197I198insY, K197I198insA and K197I198insS (where, for example, G237T238insAS denotes a modification in which an alanine (A) and a serine (S) have been inserted between the glycine at position 237 (G237) and the threonine at position 238 (T238).

b. Modifications that Increase Intrinsic Activity

In one example, additional modifications can be made to a modified factor VII polypeptide provided herein that result in increased catalytic activity toward factor X. For example, modifications can be made to the amino acids that are involved in the interaction with its cofactor, TF, such that the resulting modified FVII polypeptide has increased affinity for TF, and thereby displays increased activity toward FX. Modifications also can be made to the activation pocket of the FVII polypeptide, such that the intrinsic activity of the modified FVII polypeptide toward FX is increased compared to the activity of the unmodified polypeptide. Another modification strategy that results in increased activity involves modification of the FVII polypeptide such that the folding and conformation of the protein is altered to a more active form. For example, amino acid substitutions can be made such that the α-helix loop region (corresponding to positions 305 to 321 of the mature sequence as set forth in SEQ ID NO:3) of the protease domain is stabilized and folded more tightly to the body of the protease domain to confer a more zymogen-like shape on the modified FVII polypeptide. A more active polypeptide also can be achieved by modification of the amino acids involved in the β-strands of the FVII polypeptide. For example, amino acid substitutions can be made that introduce new cysteine pairs that can form new disulphide bonds which can function to "lock" the modified FVII polypeptide into a more active form.

Examples of additional modifications that can be included in the modified FVII polypeptides provided herein to increase the intrinsic activity of the modified FVII polypeptide include, but are not limited to, those described in Persson et al. (2004) Biochem J. 379:497-503, Maun et al. (2005) Prot Sci 14:1171-1180, Persson et al. (2001) PNAS 98:13583-13588, Persson et al. (2002) Eur J Biochem 269:5950-5955, Soejima et al. (2001) J Biol Chem 276:17229-17235, Soejima et al. (2002) J Biol Chem 277:49027-49035, WO200183725, WO2002022776, WO2002038162, WO2003027147, WO200338162, WO2004029090, WO2004029091, WO2004108763 and WO2004111242. Non-limiting examples of exemplary amino acid modifications described in the art that can result in increased intrinsic activity of the modified FVII polypeptide include any one or more of S279C/V302C, L280C/N301C, V281C/V302C, S282C/V299C, S314E, L39E, L39Q, L39H, I42R, S43Q, S53N, K62E, K62R, K62D, K62N, K62Q, K62T, L65Q, L65S, F71D, F71Y, F71E, F71Q, F71N, P74S, P74A, A75E, A75D, E77A, E82Q, E82N, T83K, E116D, K157V, K157L, K157I, K157M, K157F, K157W, K157P, K157G, K157S, K157T, K157C, K157Y, K157N, K157E, K157R, K157H, K157D, K157Q, V158L, V158I, V158M, V158F, V158W, V158P, V158G, V158S, V158T, V158C, V158Y, V158N, V158E, V158R, V158K, V158H, V158D, V158Q, A274M, A274L, A274K, A274R, A274D, A274V, A274I, A274F, A274W, A274P, A274G, A274T, A274C, A274Y, A274N, A274E, A274H, A274S, A274Q, F275H, E296V, E296L, E296I, E296M, E296F, E296W, E296P, E296G, E296S, E296T, E296C, E296Y, E296N, E296K, E296R, E296H, E296D, E296Q, M298Q, M298V, M298L, M298I, M298F, M298W, M298P, M298G, M298S, M298T, M298C, M298Y, M298N, M298K, M298R, M298H, M298E, M298D, R304Y, R304F, R304L, R304M, L305V, L305Y, L305I, L305F, L305A, L305M, L305W, L305P, L305G, L305S, L305T, L305C, L305N, L305E, L305K, L305R, L305H, L305D, L305Q, M306D, M306N, D309S, D309T, S314A, S314V, S314I, S314M, S314F, S314W, S314P, S314G, S314L, S314T, S314C, S314Y, S314N, S314E, S314K, S314R, S314H, S314D, S314Q, D334G, D334E, D334A, D334V, D334I, D334M, D334F, D334W, D334P, D334L, D334T, D334C, D334Y, D334N, D334K, D334R, D334H, D334S, D334Q, S336G, S336E, S336A, S336V, S336I, S336M, S336F, S336W, S336P, S336L, S336T, S336C, S336Y, S336N, S336K, S336R, S336H, S336D, S336Q, K337L, K337V, K337I, K337M, K337F, K337W, K337P, K337G, K337S, K337T, K337C, K337Y, K337N, K337E, K337R, K337H, K337D, K337Q, F374P, F374A, F374V, F374I, F374L, F374M, F374W, F374G, F374S, F374T, F374C, F374Y, F374N, F374E, F374K, F374R, F374H, F374D, F374Q, and substitution of positions 300-322, 305-322, 300-312, or 305-312 with the corresponding amino acids from trypsin, thrombin or FX, and substitution of positions 310-329, 311-322 or 233-329 with the corresponding amino acids from trypsin.

c. Modifications that Increase Resistance to Proteases

Modified FVII polypeptides provided herein also can contain additional modifications that result in increased resistance of the polypeptide to proteases. For example, amino acid substitutions can be made that remove one or more potential proteolytic cleavage sites. The modified FVII polypeptides can thus be made more resistant to proteases, thereby increasing the stability and half-life of the modified polypeptide.

Examples of additional modifications that can be included in the modified FVII polypeptides provided herein to increase resistance to proteases include, but are not limited to, those described in U.S. Pat. No. 5,580,560 or International Published Application Nos. WO1988010295 and WO2002038162. Non-limiting examples of exemplary modifications described in the art that can result in increased resistance of the modified FVII polypeptide to inhibitors and/or proteases include any one or more of K32Q, K32E, K32G, K32H, K32T, K32A, K32S, K38T, K38D, K38L, K38G, K38A, K38S, K38N, K38H, I42N, I42S, I42A, I42Q, Y44N, Y44S, Y44A, Y44Q, F278S, F278A, F278N, F278Q, F278G, R290G, R290A, R290S, R290T, R290K, R304G, R304T, R304A, R304S, R304N, R315G, R315A, R315S, R315T, R315Q, Y332S, Y332A, Y332N, Y332Q, Y332G, K341E, K341Q, K341G, K341T, K341A and K341S.

d. Modifications that Increase Affinity for Phospholipids

The modified FVII polypeptide provided herein also can contain one or more additional modifications to increase affinity for phospholipids. The coagulant activity of FVII can be enhanced by increasing the binding and/or affinity of the polypeptide for phospholipids, such as those expressed on the surface of activated platelets. This can be achieved, for example, by modifying the endogenous FVII Gla domain. Modification can be effected by amino acid substitution at one or more positions in the Gla domain of a FVII polypeptide that result in a modified FVII polypeptide with increased ability to bind phosphatidylserine and other negatively charged phospholipids. Examples of additional modifications to increase phospholipid binding and/or affinity and that can be made to a modified FVII polypeptide provided herein that contains an endogenous FVII Gla domain, include, but are not limited to, those described in Harvey et al. (2003) J Biol Chem 278:8363-8369, US20030100506, US20040220106, US20060240526, US6017882, U.S. Pat. No. 6,693,075, U.S. Pat. No. 6,762,286, WO200393465 and WO2004111242.

Exemplary of such modifications include any one or more of: an insertion of a tyrosine at position 4, or modification of any one or more of P10Q, P10E, P10D, P10N, R28F, R28E, K32E, K32D, D33F, D33E, D33K A34E, A34D, A34I, A34L, A34M, A34V, A34F, A34W, A34Y, R36D, R36E, K38E and K38D.

e. Modifications that Alter Glycosylation

Alteration of the extent, level and/or type of glycosylation of a protein has been described in the art as a means to reduce immunogenicity, increase stability, reduce the frequency of administration and/or reduce adverse side effects such as inflammation. Normally, this is effected by increasing the glycosylation levels. The glycosylation site(s) provides a site for attachment for a carbohydrate moiety on the polypeptide, such that when the polypeptide is produced in a eukaryotic cell capable of glycosylation, it is glycosylated.

There are four native glycosylation sites in FVII; two N-glycosylation sites at N145 and N322, and two O-glycosylation sites at S52 and S60, corresponding to amino acid positions in the mature FVII polypeptide set forth in SEQ ID NO:3. In one embodiment, additional modifications can be made to a modified FVII polypeptide provided herein such that glycosylation at the above sites is disrupted. This can result in a modified FVII polypeptide with increased coagulant activity (see, e.g., WO2005123916). Non-limiting examples of exemplary modifications described in the art that can result in decreased glycosylation and increased activity of the modified FVII polypeptide as compared to an unmodified FVII polypeptide include, but are not limited to S52A, S60A, N145Y, N145G, N145F, N145M, N145S, N145I, N145L, N145T, N145V, N145P, N145K, N145H, N145Q, N145E, N145R, N145W, N145D, N145C, N322Y, N322G, N322F, N322M, N322S, N322I, N322L, N322T, N322V, N322P, N322K, N322H, N322Q, N322E, N322R, N322W and N322C.

In another embodiment, further modifications can be made to the amino acid sequence of the modified FVII polypeptides provided herein such that additional glycosylation sites are introduced, thus increasing the level of glycosylation of the modified FVII polypeptide as compared to an unmodified FVII polypeptide. The glycosylation site can be an N-linked or O-linked glycosylation site. Examples of modifications that can be made to a FVII polypeptide that introduce one or more new glycosylation sites include, but are not limited to, those that are described in U.S. Pat. No. 6,806,063 and WO200393465. Non-limiting examples of exemplary modifications described in the art that can result in increased glycosylation of the modified FVII polypeptide as compared to an unmodified FVII polypeptide include, but are not limited to F4S, F4T, P10N, Q21N, W41N, S43N, A51N, G58N, L65N, G59S, G59T, E82S, E82T, N95S, N95T, G97S, G97T, Y101N, D104N, T106N, K109N, G117N, G124N, S126N, T128N, A175S, A175T, G179N, I186S, I186T, V188N, R202S, R202T, I205S, I205T, D212N, E220N, I230N, P231N, P236N, G237N, V253N, E265N, T267N, E270N, R277N, L280N, G291N, P303S, P303ST, L305N, Q312N, G318N, G331N, D334N, K337N, G342N, H348N, R353N, Y357N, I361N, V376N, R379N, M391N, K32N/A34S, K32N/A34T, F31N/D33S, F31N/D33T, I30N/K32S, I30N/K32T, A34N/R36S, A34N/R36T, K38N/F40S, K38N/F40T, T37N/L39S, T37N/L39T, R36N/K38S, R36N/K38T, L39N/W41S, L39N/W41T, F40N/I42S, F40N/I42T, I42N/Y44S, I42N/Y44T, Y44N/D46S, Y44N/D46T, D46N/D48S, D46N/D48T, G47N/Q49S, G47N/Q49T, S52N/P54S, Q66N/Y68S, S119N/L121S, A122N/G124S, T128N/P129A, T130N/E132S, K143N/N145S, K143N/N145T, E142N/R144S, E142N/R144T, L141N/K143S, L141N/K143T, I140N/E142S/, I140N/E142T, R144N/A146S, R144N/A146T, A146N/K148S, A146N/K148T, S147N/P149S/, S147N/P149T, R290N/A292S, R290N/A292T, A292N/A294S, D289N/G291S, D289N/G291T, L288N/R290S, L288N/R290T, L287N/D289S, L287N/D289T, A292N/A294S, A292N/A294T, T293N/L295S, T293N/L295T, R315N/N317S, R315N/N317T, S314N/K316S, S314N/K316T, Q313N/R315S, Q313N/R315T, K316N/G318S, K316N/G318T, V317N/D319S, V317N/D319T, K341N/D343S, K341N/D343T, S339N/K341S, S339N/K341T, D343N/G345S, D343N/G345T, R392N/E394S, R392N/E394T, L390N/R392S, L390N/R392T, K389N/M391S, K389N/M391T, S393N/P395S, S393N/P395T, E394N/R396S, E394N/R396T, E394N/P395A/R396S, P395N/P397S, P395N/P397T, R396N/G398S, R396N/G398T, P397N/V399S, P397N/V399T, G398N/L400S, G398N/L400T, V399N/L401S, V399N/L401T, L400N/R402S, L400N/R402T, L401N/A403S, L401N/A403T, R402N/P404S, R402N/P404T, A403N/F405S, A403N/F405T, P404N/P406S and P404N/P406T.

f. Modifications to Facilitate Chemical Group Linkage

Additional modifications of a modified FVII polypeptide provided herein also can be made to facilitate subsequent linkage of a chemical group. One or more amino acid substitutions or insertions can be made such that a chemical group can be linked to a modified FVII polypeptide via the substituted amino acid. For example, a cysteine can be introduced to a modified FVII polypeptide, to which a polyethylene glycol (PEG) moiety can be linked to confer increased stability and serum half-life. Other attachment residues include lysine, aspartic acid and glutamic acid residues. In some embodiments, amino acids residues are replaced to reduce the number of potential linkage positions. For example, the number of lysines can be reduced. Examples of modifications that can be made to the amino acid sequence of a FVII polypeptide which can facilitate subsequent linkage with a chemical group include, but are not limited to, those that are described in US20030096338, US20060019336, U.S. Pat. No. 6,806,063, WO200158935 and WO2002077218. Non-limiting examples of exemplary modifications of a FVII polypeptides that can facilitate subsequent linkage with a chemical group include, but are not limited to Q250C, R396c, P406C, I42K, Y44K, L288K, D289K, R290K, G291K, A292K, T293K, Q313K, S314K, R315K, V317K, L390K, M391K, R392K, S393K, E394K, P395K, R396K, P397K, G398K, V399K, L400K, L401K, R402K, A403K, P404K, F405K, I30C, K32C, D33C, A34C, T37C, K38C, W41C, Y44C, S45C, D46C, L141C, E142C, K143C, R144c, L288C, D289C, R290c, G291C, A292C, S314C, R315c, K316C, V317C, L390C, M391C, R392C, S393C, E394C, P395C, R396c, P397C, G398C, V399C, L401C, R402c, A403C, P404C, I30D, K32D, A34D, T37D, K38D, W41D, Y44D, S45D, D46C, L141D, E142D, K143D, R144D, L288D, R290D, G291D, A292D, Q313D, S314D, R315D, K316D, V317D, L390D, M391D, R392D, S393D, P395D, R396D, P397D, G398D, V399D, L401D, R402D, A403D, P404D, I30E, K32E, A34E, T37E, K38E, W41E, Y44E, S45E, D46C, L141E, E142E, K143E, R144E, L288E, R290E, G291E, A292E, Q313E, S314E, R315E, K316E, V317E, L390E, M391E, R392E, S393E, P395E, R396E, P397E, G398E, V399E, L401E, R402E, A403E, P404E, K18R, K32R, K38R, K62R, K85R, K109R, K137R, K143R, K148R, K157R, K161R, K197R, K199R, K316R, K337R, K341R, K389R, K18Q, K32Q, K38Q, K62Q, K85Q, K109Q, K137Q, K143Q, K148Q, K157Q, K161Q, K197Q, K199Q, K316Q, K337Q, K341Q, K389Q, K18N, K32N, K38N, K62N, K85N, K109N, K137N, K143N, K148N, K157N, K161N, K197N, K199N, K316N, K337N, K341N, K389N, K18H, K32H, K38H, K62H, K85H, K109H, K137H, K143H, K148H, K157H, K161H, K197H, K199H, K316H, K337H, K341H and K389H.

g. Exemplary Combination Mutations

Provided herein are modified FVII polypeptides that have two or more modifications designed to affect one or properties or activities of an unmodified FVII polypeptide. In some examples, the two or more modifications alter two or more properties or activities of the FVII polypeptide. The modifications can be made to the FVII polypeptides such that one or more of catalytic activity, resistance to AT-III, resistance to TFPI, resistance to inhibition by $Zn^{2+}$, intrinsic activity, amidolytic activity, phospholipid binding and/or affinity, glycosylation, resistance to proteases, half-life and interaction with other factors or molecules, such as FX, FIX, serum albumin and platelet integrin $\alpha_{IIb}\beta_3$, is altered. Typically, the two or more modifications are combined such that the resulting modified FVII polypeptide has increased coagulant activity, increased duration of coagulant activity, and/or an enhanced therapeutic index compared to an unmodified FVII polypeptide. The modifications can include amino acid substitution, insertion or deletion. The increased coagulant activity, increased duration of coagulant activity, and/or an enhanced therapeutic index of the modified FVII polypeptide containing two or more modifications can be increased by at least or about 1%, 2%, 3%, 4%, 5%, 6%, 7%, 8%, 9%, 10%, 20%, 30%, 40%, 50%, 60%, 70%, 80%, 90%, 100%, 110%, 120%, 130%, 140%, 150%, 160%, 170%, 180%, 190%, 200%, 300%, 400%, 500%, or more compared to the activity of the starting or unmodified FVIIa polypeptide.

Provided herein are modified FVII polypeptides that contain two or more modifications that are introduced into an unmodified FVII polypeptide to alter two or more activities or properties. The modified FVII polypeptides can contain 2, 3, 4, 5, 6 or more modifications. Further, each modification can involve one or more amino acid residues. For example, a modified FVII polypeptide can contain two modifications each of which is a single amino acid substitution. In another example, a modified FVII polypeptide can contain two modifications, one of which is a single amino acid substitution and the other of which involves deletion of more than one amino acid residue and then insertion of more than one amino acid residue. For example, a modified FVII polypeptide provided herein can contain the amino acid substitution S222A (residues corresponding to a mature FVII polypeptide set forth in SEQ ID NO:3) to disrupt $Zn^{2+}$ binding and a Gla Swap FIX modification, which involves deletion of the endogenous FVII Gla domain by deleting amino acid residues A1 to Y44 (residues corresponding to a mature FVII polypeptide set forth in SEQ ID NO:3) and insertion of 45 amino acid residues that correspond to amino acid residues Y1 to Y45 of the FIX Gla domain set forth in SEQ ID NO:83.

Modified FVII polypeptides provided herein can have two or more modifications selected solely from those set forth in Tables 5 to 13. In other examples, the modified FVII polypeptide contains two or more modifications where one or more modifications are selected from those set forth in Tables 5 to 13 and one or more modifications are additional modifications that are not set forth in Tables 5 to 13, such as, for example, modifications described in the art. In some examples, the one or more additional modifications can be selected from those set forth in Section D.6.a-e, above. For example, a modified FVII polypeptide can contain a modification at one or more of amino acid residues D196, K197, K199, G237, T239, R290 or K341 based on numbering of a mature FVII set forth in SEQ ID NO:3 (corresponding to D60, K60a, K60c, G97, T99, R147 and K192, respectively, based on chymotrypsin numbering), which can increase resistance to TFPI, and a modification at one or more amino acid residues that affects intrinsic activity, such as, for example, V158 and M298, (V21 and M156, respectively, based on chymotrypsin numbering). For example, a modified FVII polypeptide can contain two amino acid substitutions that increase resistance to TFPI, such as K197E and G237V, and one amino acid substitution that increases intrinsic activity, such as M298Q, resulting in a FVII polypeptide with increased coagulant activity.

Exemplary of the combination modifications provided herein are those that include at least the Q286R mutation (numbering corresponding to the mature FVII polypeptide set forth in SEQ ID NO:3; corresponding to Q143R by chymotrypsin numbering). The modified FVII polypeptides containing the Q286R modification can contain 1, 2, 3, 4, 5, 6 or more additional modifications. These additional modifications can be included to, for example, alter catalytic activity, resistance to AT-III, resistance to TFPI, resistance to inhibition by $Zn^{2+}$, intrinsic activity, amidolytic activity, phospholipid binding and/or affinity, glycosylation, resistance to proteases, half-life and interaction with other factors or molecules, such as FX, FIX, serum albumin and platelet integrin $\alpha_{IIb}\beta_3$. Typically, the modified FVII polypeptides provided herein that contain two or more modifications, wherein one modification is the amino acid substitution Q286R, exhibit increased coagulant activity compared to the wild-type FVII polypeptide.

In some examples, the modified FVII polypeptides containing two or more modifications, wherein one is Q286R, exhibit increased catalytic and coagulant activity compared to the wild type polypeptide as well as compared to a FVII polypeptide containing any one of the mutations alone. For example, provided herein are modified FVII polypeptides that contain both the Q286R and M289Q amino acid substitutions (Q286R/M298Q with numbering corresponding to the mature FVII polypeptide set forth in SEQ ID NO:3; corresponding to Q143R/M156Q by chymotrypsin numbering). The Q286R/M298Q combination FVII mutant exhibits increased catalytic activity for its substrate, Factor X, compared to wild type FVII, the Q286R single mutant and the M298Q single mutant (see e.g. Example 4, below). For example, in one study, the M298Q mutant exhibited a catalytic activity for FX, in the presence of TF, that was about 1.8 to 2 times greater than that of the wild-type polypeptide, the catalytic activity of the Q286R mutant was approximately 2.1 times greater than that of the wild-type FVII polypeptide, and the Q286R/M298Q mutant exhibited a catalytic activity for FX that was approximately 3.6-4.4 times that of the catalytic activity of the wild-type polypeptide for FX (see Table 15, below).

Non-limiting exemplary combination modifications are provided in Table 12. These exemplary combination modifications include two or more modifications that are designed to alter two or more activities or properties of a FVII polypeptide, including, but not limited to, resistance to TFPI, resistance to AT-III, intrinsic activity, amidolytic activity, catalytic activity, $Zn^{2+}$ binding, phospholipid binding and/or affinity, glycosylation, resistance to proteases, half-life and interaction with other factors or molecules, such as FX and FIX. Modified FVII polypeptides containing such combination modifications can have increased coagulant activity, increased duration of coagulant activity, and/or an enhanced therapeutic index. The modifications set forth in Table 12 below use the same nomenclature and numbering systems as described in Tables 5 to 11, above. For example, the "Gla Swap FIX" modification involves deletion of the endogenous FVII Gla domain by deleting amino acid residues A1 to Y44 (residues corresponding to a mature FVII polypeptide set forth in SEQ ID NO:3) and insertion of 45 amino acid residues that correspond to amino acid residues Y1 to Y45 of the FIX Gla domain set forth in SEQ ID NO:83, as described above. In some examples, the "Gla Swap FIX" modification also contains one or more amino acid substitutions in the FIX Gla domain portion compared to a wild type FIX Gla domain, as discussed above. For example, the Gla Swap FIX modification also can include a M19K amino acid substitution (numbering corresponding amino acid positions of the FIX Gla domain set forth in SEQ ID NO:83). Such a modification is denoted by {Gla Swap FIX/M19K}, i.e. the modified FVII polypeptide contains a heterologous FIX Gla domain in which the methionine at the position corresponding to position 19 of the FIX Gla domain set forth in SEQ ID NO:83 is replaced with a lysine. Thus, modifications made to the heterologous FIX Gla domain portions are referenced using amino acid positions corresponding to amino acid positions of the mature wild type FIX polypeptide, or the wild type FIX Gla domain set forth in SEQ ID NO:83. Modifications made to amino acid positions in the FVII polypeptide are referenced using amino acid positions corresponding to amino acid positions of a mature FVII polypeptide as set forth in SEQ ID NO:3 and also are referred to by the chymotrypsin numbering scheme. For example, a modified FVII polypeptide containing the Q286R modification (numbering corresponding to the mature FVII polypeptide set forth in SEQ ID NO:3), and a Gla swap FIX modification, wherein the FIX Gla domain contains the M19K amino acid substitution (numbering corresponding amino acid positions of the FIX Gla domain set forth in SEQ ID NO:83), is denoted by {Gla Swap FIX/M19K}/Q286R. Similarly, the modification {Gla Swap FIX/Q44S}/Q286R/M298Q denotes that the FVII polypeptide contains a Gla swap FIX modification wherein the glutamine at the amino acid position corresponding to amino acid position 44 of the FIX Gla domain set forth in SEQ ID NO:83 is replaced with a serine, and also contains the Q286R and M298Q amino acid substitutions, with numbering corresponding to the mature FVII polypeptide set forth in SEQ ID NO:3. In Table 12 below, the sequence identifier (SEQ ID NO) is identified in which exemplary amino acid sequences of the modified FVII polypeptide are set forth.

TABLE 12

| Modification - mature FVII numbering | Modification - chymotrypsin numbering | SEQ ID NO |
|---|---|---|
| Gla Swap FIX/Q286R | Gla Swap FIX/Q143R | 131 |
| Q286R/H257A | H117A/Q143R | 132 |
| S222A/Q286R | S82A/Q143R | 133 |
| Q286R/S222A/H257A | S82A/H117A/Q143R | 134 |
| Gla Swap FIX/S222A/Q286R | S82A/Gla Swap FIX/Q143R | 135 |
| Gla Swap FIX/H257A/Q286R | H117A/Gla Swap FIX/Q143R | 136 |
| Gla Swap FIX/ S222A/H257A/Q286R | Q143R/S82A/H117A/Gla Swap FIX | 137 |
| Q286R/M298Q | Q143R/M156Q | 138 |
| Q286R/M298Q/K341Q | Q143R/M156Q/K192Q | 139 |
| K199E/Q286R/M298Q | K60cE/Q143R/M156Q | 140 |
| Gla Swap FIX/Q286R/M298Q | Gla Swap FIX/Q143R/M156Q | 141 |
| Q286R/Q366V | Q143R/Q217V | 142 |
| Q286R/A292N/A294S/Q366V | Q143R/A150N/A152S/Q217V | 143 |
| A175S/Q286R/Q366V | A39S/Q143R/Q217V | 144 |
| S222A/Q286R/Q366V | S82A/Q143R/Q217V | 145 |
| H257S/Q286R | H117S/Q143R | 146 |
| H257S/Q286R/Q366V | H117S/Q143R/Q217V | 147 |
| S222A/H257A/Q286R/Q366V | S82A/H117A/Q143R/Q217V | 148 |
| Q286R/H373A | Q143R/H224A | 149 |
| S222A/H257A/Q286R/M298Q | S82A/H117A/Q143R/M156Q | 150 |
| Q286R/K341D | Q143R/K192D | 151 |
| Q286R/Q366D | Q143R/Q217D | 152 |
| Q286R/Q366N | Q143R/Q217N | 153 |
| Q286R/M298Q/Q366D | Q143R/M156Q/Q217D | 154 |
| Q286R/M298Q/Q366N | Q143R/M156Q/Q217N | 155 |
| Q286R/H373F | Q143R/H224F | 156 |
| Q286R/M298Q/H373F | Q143R/M156Q/H224F | 157 |
| Gla Swap FIX/S222A | Gla Swap FIX/S82A | 245 |
| Gla Swap FIX/H257A | Gla Swap FIX/H117A | 246 |
| Gla Swap FIX/S222A/H257A | Gla Swap FIX/S82A/H117A | 247 |
| S222A/M298Q | S82A/M156Q | 248 |
| H257A/M298Q | H117A/M156Q | 249 |
| S222A/H257A/M298Q | S82A/H117A/M156Q | 250 |
| S222A/A292N/A294S/Q366V | S82A/A150N/A152S/Q217V | 251 |
| A175S/S222A/Q366V | A39S/S82A/Q217V | 252 |
| S222A/Q366V | S82A/Q217V | 253 |
| H257S/Q366V | H117S/Q217V | 254 |
| S222A/H373A | S82A/H224A | 255 |
| V158T/L287T/M298K | V21T/L144T/M156K | 256 |
| V158D/L287T/M298K | V21D/L144T/M156K | 257 |
| S103S111delinsIEDICLPRWGCLWE/G237V | S[103]S[111]delinsIEDICLPRWGCLWE/G97V | 258 |
| S103S111delinsDICLPRWGCLWED/G237V | S[103]S[111]delinsDICLPRWGCLWED/G97V | 259 |
| H115S126delinsQRLMEDICLPRWGCLWEDDF/G237V | H[115]S[126]delinsQRLMEDICLPRWGCLWEDDF/G97V | 260 |
| H115S126delinsIEDICLPRWGCLWE/G237V | H[115]S[126]delinsIEDICLPRWGCLWE/G97V | 261 |

TABLE 12-continued

| Modification - mature FVII numbering | Modification - chymotrypsin numbering | SEQ ID NO |
|---|---|---|
| H115S126delinsDICLPRWGCLWED/G237V | H[115]S[126]delinsDICLPRWGCLWED/G97V | 262 |
| T128P134delinsQRLMEDICLPRWGCLWEDDF/G237V | T[128]P[134]delinsQRLMEDICLPRWGCLWEDDF/G97V | 263 |
| T128P134delinsIEDICLPRWGCLWE/G237V | T[128]P[134]delinsIEDICLPRWGCLWE/G97V | 264 |
| S103S111delinsQRLMEDICLPRWGCLWEDDF/G237V | S[103]S[111]delinsQRLMEDICLPRWGCLWEDDF/G97V | 265 |
| T128P134delinsDICLPRWGCLWED/G237V | T[128]P[134]DICLPRWGCLWED/G97V | 266 |
| S103S111delinsSFGRGDIRNV/G237V | S[103]S[111]delinsSFGRGDIRNV/G97V | 267 |
| H115S126delinsSFGRGDIRNV/G237V | H[115]S[126]delinsSFGRGDIRNV/G97V | 268 |
| T128P134delinsSFGRGDIRNV/G237V | T[128]P[134]delinsSFGRGDIRNV/G97V | 269 |
| M298Q/H373F | M156Q/H224F | 270 |
| S119N/L121S/A175S | S[119]N/L[121]S/A39S | 271 |
| T128N/P129A/A175S | T[128]N/P[129]A/A39S | 272 |
| A122N/G124S/A175S | A[122]N/G[124]S/A39S | 273 |
| {Gla Swap FIX/E40L}/Q286R/M298Q | {Gla Swap FIX/E[40]L}/Q143R/M156Q | 274 |
| {Gla Swap FIX/K43I}/Q286R/M298Q | {Gla Swap FIX/K[43]I}/Q143R/M156Q | 275 |
| {Gla Swap FIX/Q44S}/Q286R/M298Q | {Gla Swap FIX/Q[44]S}/Q143R/M156Q | 276 |
| {Gla Swap FIX/M19K}/Q286R/M298Q | {Gla Swap FIX/M[19]K}/Q143R/M156Q | 277 |
| {Gla Swap FIX/M19K/E40L/K43I/Q44S}/Q286R/M298Q | {GlaSwapFIX/M[19]K/E[40]L/K[43]I/Q[44]S}/Q143R/M156Q | 278 |
| T128N/P129A/Q286R | T[128]N/P[129]A/Q143R | 279 |
| T128N/P129A/Q286R/M298Q | T[128]N/P[129]A/Q143R/M156Q | 280 |
| T128N/P129A/Q286R/H373F | T[128]N/P[129]A/Q143R/H224F | 281 |
| V158D/Q286R/E296V/M298Q | V21D/Q143R/E154V/M156Q | 282 |
| T128N/P129A/V158D/E296V/M298Q | T[128]N/P[129]A/V21D/E154V/M156Q | 283 |
| T128N/P129A/S222A | T[128]N/P[129]A/S82A | 284 |
| GlaSwapFIX/T128N/P129A/S222A/Q286R | GlaSwapFIX/T[128]N/P[129]A/S82A/Q143R | 285 |
| GlaSwapFIX/T128N/P129A/Q286R/M298Q | GlaSwapFIX/T[128]N/P[129]A/Q143R/M156Q | 286 |
| T128N/P129A/S222A/H257A/Q286R/M298Q | T[128]N/P[129]A/S82A/H117A/Q143R/M156Q | 287 |
| T128N/P129A/Q286R/M298Q/H373F | T[128]N/P[129]A/Q143R/M156Q/H224F | 288 |
| S52A/S60A/V158D/E296V/M298Q | S[52]A/S[60]A/V21D/E154V/M156Q | 289 |
| S52A/S60A/Q286R | S[52]A/S[60]A/Q143R | 290 |
| S52A/S60A/S222A | S[52]A/S[60]A/S82A | 291 |
| GlaSwapFIX/S52A/S60A/S222A/Q286R | GlaSwapFIX/S[52]A/S[60]A/S82A/Q143R | 292 |
| S52A/S60A/Q286R/M298Q | S[52]A/S[60]A/Q143R/M156Q | 293 |
| GlaSwapFIX/S52A/S60A/Q286R/M298Q | GlaSwapFIX/S[52]A/S[60]A/Q143R/M156Q | 294 |
| S52A/S60A/S222A/H257A/Q286R/M298Q | S[52]A/S[60]A/S82A/H117A/Q143R/M156Q | 298 |
| S52A/S60A/Q286R/H373F | S[52]A/S[60]A/Q143R/H224F | 296 |
| S52A/S60A/Q286R/M298Q/H373F | S[52]A/S[60]A/Q143R/M156Q/H224F | 297 |
| V158D/T239V/E296V/M298Q | V21D/T99V/E154V/M156Q | 298 |
| T239V/Q286R | T99V/Q143R | 299 |
| S222A/T239V | S82A/T99V | 300 |
| Gla Swap FIX/S222A/T239V/Q286R | Gla Swap FIX/S82A/T99V/Q143R | 301 |
| T239V/Q286R/M298Q | T99V/Q143R/M156Q | 302 |
| S222A/T239V/H257A/Q286R/M298Q | S82A/T99V/H117A/Q143R/M156Q | 303 |
| GlaSwapFIX/T239V/Q286R/M298Q | GlaSwapFIX/T99V/Q143R/M156Q | 304 |
| T239V/Q286R/H373F | T99V/Q143R/H224F | 305 |
| T239V/Q286R/M298Q/H373F | T99V/Q143R/M156Q/H224F | 306 |
| V158D/T239I/E296V/M298Q | V21D/T99I/E154V/M156Q | 307 |
| T239I/Q286R | T99I/Q143R | 308 |
| S222A/T239I | S82A/T99I | 309 |
| GlaSwapFIX/S222A/T239I/Q286R | GlaSwapFIX/S82A/T99I/Q143R | 310 |
| T239I/Q286R/M298Q | T99I/Q143R/M156Q | 311 |
| S222A/T239I/H257A/Q286R/M298Q | S82A/T99I/H117A/Q143R/M156Q | 312 |
| GlaSwapFIX/T239I/Q286R/M298Q | GlaSwapFIX/T99I/Q143R/M156Q | 313 |
| T239I/Q286R/H373F | T99I/Q143R/H224F | 314 |
| T239I/Q286R/M298Q/H373F | T99I/Q143R/M156Q/H224F | 315 |
| GlaSwapFIX/S222A/Q286R/H373F | GlaSwapFIX/S82A/Q143R/H224F | 316 |

TABLE 12-continued

| Modification - mature FVII numbering | Modification - chymotrypsin numbering | SEQ ID NO |
|---|---|---|
| GlaSwapFIX/S222A/Q286R/M298Q | GlaSwapFIX/S82A/Q143R/M156Q | 317 |
| GlaSwapFIX/S222A/Q286R/M298Q/H373F | GlaSwapFIX/S82A/Q143R/M156Q/H224F | 318 |
| V158D/E296V/M298Q/H373F | V21D/E154V/M156Q/H224F | 319 |
| V158D/Q286R/E296V/M298Q/H373F | V21D/Q143R/E154V/M156Q/H224F | 320 |
| H257A/Q286R/M298Q | H117A/Q143R/M156Q | 321 |
| H257S/Q286R/M298Q | H117S/Q143R/M156Q | 322 |
| GlaSwapFIX/S222A/H257S/Q286R | GlaSwapFIX/S82A/H117S/Q143R | 323 |
| S222A/H257S/Q286R/M298Q | S82A/H117S/Q143R/M156Q | 324 |
| H257S/Q286R/M298Q/H373F | H117S/Q143R/M156Q/H224F | 325 |
| S222A/Q286R/M298Q/H373F | S82A/Q143R/M156Q/H224F | 326 |
| GlaSwapFIX/Q366V | GlaSwapFIX/Q217V | 327 |
| S222A/Q286R/M298Q | S82A/Q143R/M156Q | 328 |
| T128N/P129A/A175S/Q366V | T[128]N/P[129]A/A39S/Q217V | 329 |
| A122N/G124S/A175S/Q366V | A[122]N/G[124]S/A39S/Q217V | 330 |
| T128N/P129A/A175S/S222A | T[128]N/P[129]A/A39S/S82A | 331 |
| A122N/G124S/A175S/S222A | A[122]N/G[124]S/A39S/S82A | 332 |
| T128N/P129A/A175S/Q286R | T[128]N/P[129]A/A39S/Q143R | 333 |
| A122N/G124S/A175S/Q286R | A[122]N/G[124]S/A39S/Q143R | 334 |
| GlaSwapFIX/T128N/P129A/A175S/S222A/Q286R | GlaSwapFIX/T[128]N/P[129]A/A39S/S82A/Q143R | 335 |
| GlaSwapFIX/A122N/G124S/A175S/S222A/Q286R | GlaSwapFIX/A[122]N/G[124]S/A39S/S82A/Q143R | 336 |
| T128N/P129A/A175S/Q286R/M298Q | T[128]N/P[129]A/A39S/Q143R/M156Q | 337 |
| A122N/G124S/A175S/Q286R/M298Q | A[122]N/G[124]S/A39S/Q143R/M156Q | 338 |
| T128N/P129A/A175S/S222A/H257A/Q286R/M298Q | T[128]N/P[129]A/A39S/S82A/H117A/Q143R/M156Q | 339 |
| A122N/G124S/A175S/S222A/H257A/Q286R/M298Q | A[122]N/G[124]S/A39S/S82A/H117A/Q143R/M156Q | 340 |
| T128N/P129A/A175S/Q286R/M298Q/H373F | T[128]N/P[129]A/A39S/Q143R/M156Q/H224F | 341 |
| A122N/G124S/A175S/Q286R/M298Q/H373F | A[122]N/G[124]S/A39S/Q143R/M156Q/H224F | 342 |
| T128N/P129A/M298Q | T[128]N/P[129]A/M156Q | 354 |
| {Gla Swap FIX/K43I}/T128N/P129A/Q286R/M298Q | {Gla Swap FIX/K[43]I}/T[128]N/P[129]A/Q143R/M156Q | 355 |
| T128N/P129A/Q286R/M298Q/Q366N | T[128]N/P[129]A/Q143R/M156Q/Q217N | 356 |
| {Gla Swap FIX/K43I}/Q286R/M298Q/Q366N | {Gla Swap FIX/K[43]I}/Q143R/M156QQ217N | 357 |
| {Gla Swap FIX/K43I}/T128N/P129A/Q286R/M298Q/Q366N | {Gla Swap FIX/K[43]I}/T[128]N/P[129]A/Q143R/M156Q/Q217N | 358 |
| T128N/P129A/M298Q/H373F | T[128]N/P[129]A/M156Q/H224F | 359 |
| V158D/Q286R/E296V/M298Q | V21D/Q143R/E154V/M156Q | 360 |
| M298Q/Q366N/H373F | M156Q/Q217N/H224F | 361 |
| T239V/M298Q/H373F | T99V/M156Q/H224F | 362 |
| T239I/M298Q/H373F | T99I/M156Q/H224F | 363 |
| T128N/P129A/Q286R/M298Q/Q366N/H373F | T[128]N/P[129]A/Q143R/M156Q/Q217N/H224F | 364 |
| T239V/Q286R/M298Q/Q366N | T99V/Q143R/M156Q/Q217N | 365 |
| T239I/Q286R/M298Q/Q366N | T99I/Q143R/M156Q/Q217N | 366 |
| T128N/P129A/T239V/Q286R/M298Q | T[128]N/P[129]A/T99V/Q143R/M156Q | 367 |
| T128N/P129A/S222A/T239V/H257A/Q286R/M298Q | T[128]N/P[129]A/S82A/T99V/H117A/Q143R/M156Q | 368 |
| T128N/P129A/T239V/Q286R/M298Q/H373F | T[128]N/P[129]A/T99V/Q143R/M156Q/H224F | 369 |
| T128N/P129A/T239I/Q286R/M298Q | T[128]N/P[129]A/T99I/Q143R/M156Q | 370 |
| T128N/P129A/T239I/Q286R/M298Q/H373F | T[128]N/P[129]A/T99I/Q143R/M156Q/H224F | 371 |

E. Production of FVII Polypeptides

FVII polypeptides, including modified FVII polypeptides, or domains thereof of FVII or other vitamin-K polypeptide, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a FVII polypeptide or other vitamin-K polypeptide, such as from a cell or tissue source, such as for example from liver. Modified FVII polypeptides can be engineered as described herein, such as by site-directed mutagenesis.

FVII can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a FVII polypeptide, including for example, polymerase chain reaction (PCR)

methods. A nucleic acid containing material can be used as a starting material from which a FVII-encoding nucleic acid molecule can be isolated. For example, DNA and mRNA preparations, cell extracts, tissue extracts (e.g. from liver), fluid samples (e.g. blood, serum, saliva), samples from healthy and/or diseased subjects can be used in amplification methods. Nucleic acid libraries also can be used as a source of starting material. Primers can be designed to amplify a FVII-encoding molecule. For example, primers can be designed based on expressed sequences from which a FVII is generated. Primers can be designed based on back-translation of a FVII amino acid sequence. Nucleic acid molecules generated by amplification can be sequenced and confirmed to encode a FVII polypeptide.

Additional nucleotide sequences can be joined to a FVII-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a FVII-encoding nucleic acid molecule. Examples of such sequences include, but are not limited to, promoter sequences designed to facilitate intracellular protein expression, and secretion sequences designed to facilitate protein secretion. Additional nucleotide sequences such as sequences specifying protein binding regions also can be linked to FVII-encoding nucleic acid molecules. Such regions include, but are not limited to, sequences to facilitate uptake of FVII into specific target cells, or otherwise enhance the pharmacokinetics of the synthetic gene.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and FVII protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated FVII protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the FVII proteins, the nucleic acid containing all or a portion of the nucleotide sequence encoding the FVII protein can be inserted into an appropriate expression vector, i.e., a vector that contains the necessary elements for the transcription and translation of the inserted protein coding sequence. Exemplary of such a vector is any mammalian expression vector such as, for example, pCMV. The necessary transcriptional and translational signals also can be supplied by the native promoter for a FVII genes, and/or their flanking regions.

Also provided are vectors that contain nucleic acid encoding the FVII or modified FVII. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a FVII polypeptide or modified FVII polypeptide thereof by growing the above-described cells under conditions whereby the encoded FVII protein is expressed by the cell, and recovering the expressed FVII protein. For purposes herein, the FVII can be secreted into the medium.

In one embodiment, vectors containing a sequence of nucleotides that encodes a polypeptide that has FVII activity and contains all or a portion of the FVII polypeptide, or multiple copies thereof, are provided. The vectors can be selected for expression of the FVII polypeptide or modified FVII polypeptide thereof in the cell or such that the FVII protein is expressed as a secreted protein. When the FVII is expressed the nucleic acid is linked to nucleic acid encoding a secretion signal, such as the *Saccharomyces cerevisiae* α-mating factor signal sequence or a portion thereof, or the native signal sequence.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a FVII polypeptide or modified FVII polypeptide, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a FVII protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl.*

Acad. Sci. USA 78:1441-1445 (1981)), the regulatory sequences of the metallothionein gene (Brinster et al., Nature 296:39-42 (1982)); prokaryotic expression vectors such as the β-lactamase promoter (Jay et al., (1981) Proc. Natl. Acad. Sci. USA 78:5543) or the tac promoter (DeBoer et al., Proc. Natl. Acad. Sci. USA 80:21-25 (1983)); see also "Useful Proteins from Recombinant Bacteria": in Scientific American 242:79-94 (1980)); plant expression vectors containing the nopaline synthetase promoter (Herrara-Estrella et al., Nature 303:209-213 (1984)) or the cauliflower mosaic virus 35S RNA promoter (Gardner et al., Nucleic Acids Res. 9:2871 (1981)), and the promoter of the photosynthetic enzyme ribulose bisphosphate carboxylase (Herrera-Estrella et al., Nature 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., Cell 38:639-646 (1984); Ornitz et al., Cold Spring Harbor Symp. Quant. Biol. 50:399-409 (1986); MacDonald, Hepatology 7:425-515 (1987)); insulin gene control region which is active in pancreatic beta cells (Hanahan et al., Nature 315:115-122 (1985)), immunoglobulin gene control region which is active in lymphoid cells (Grosschedl et al., Cell 38:647-658 (1984); Adams et al., Nature 318:533-538 (1985); Alexander et al., Mol. Cell. Biol. 7:1436-1444 (1987)), mouse mammary tumor virus control region which is active in testicular, breast, lymphoid and mast cells (Leder et al., Cell 45:485-495 (1986)), albumin gene control region which is active in liver (Pinckert et al., Genes and Devel. 1:268-276 (1987)), alpha-fetoprotein gene control region which is active in liver (Krumlauf et al., Mol. Cell. Biol. 5:1639-1648 (1985); Hammer et al., Science 235:53-58 1987)), alpha-1 antitrypsin gene control region which is active in liver (Kelsey et al., Genes and Devel. 1:161-171 (1987)), beta globin gene control region which is active in myeloid cells (Magram et al., Nature 315:338-340 (1985); Kollias et al., Cell 46:89-94 (1986)), myelin basic protein gene control region which is active in oligodendrocyte cells of the brain (Readhead et al., Cell 48:703-712 (1987)), myosin light chain-2 gene control region which is active in skeletal muscle (Shani, Nature 314:283-286 (1985)), and gonadotrophic releasing hormone gene control region which is active in gonadotrophs of the hypothalamus (Mason et al., Science 234:1372-1378 (1986)).

In a specific embodiment, a vector is used that contains a promoter operably linked to nucleic acids encoding a FVII polypeptide or modified FVII polypeptide, or a domain, fragment, derivative or homolog, thereof, one or more origins of replication, and optionally, one or more selectable markers (e.g., an antibiotic resistance gene). Vectors and systems for expression of FVII polypeptides include the well known Pichia vectors (available, for example, from Invitrogen, San Diego, Calif.), particularly those designed for secretion of the encoded proteins. Exemplary plasmid vectors for expression in mammalian cells include, for example, pCMV. Exemplary plasmid vectors for transformation of E. coli cells, include, for example, the pQE expression vectors (available from Qiagen, Valencia, Calif.; see also literature published by Qiagen describing the system). pQE vectors have a phage T5 promoter (recognized by E. coli RNA polymerase) and a double lac operator repression module to provide tightly regulated, high-level expression of recombinant proteins in E. coli, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of E. coli cells, include, for example, the pET expression vectors (see, U.S. Pat. No. 4,952,496; available from NOVAGEN, Madison, Wis.; see, also literature published by Novagen describing the system). Such plasmids include pET 11a, which contains the T7lac promoter, T7 terminator, the inducible E. coli lac operator, and the lac repressor gene; pET 12a-c, which contains the T7 promoter, T7 terminator, and the E. coli ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

2. Expression Systems

FVII polypeptides (modified and unmodified) can be produced by any methods known in the art for protein production including in vitro and in vivo methods such as, for example, the introduction of nucleic acid molecules encoding FVII into a host cell, host animal and expression from nucleic acid molecules encoding FVII in vitro. FVII and modified FVII polypeptides can be expressed in any organism suitable to produce the required amounts and forms of a FVII polypeptide needed for administration and treatment. Expression hosts include prokaryotic and eukaryotic organisms such as E. coli, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeasts such as Saccharomyces cerevisiae and Pichia pastoris, insect cells such as Drosophila cells and lepidopteran cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs. Transgenic animals for the production of wild-type FVII polypeptides are known in the art (U.S. Patent Publication Nos. 20020166130 and 20040133930) and can be adapted for production of modified FVII polypeptides provided herein.

Many expression vectors are available and known to those of skill in the art for the expression of FVII. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

FVII or modified FVII polypeptides also can be utilized or expressed as protein fusions. For example, a fusion can be generated to add additional functionality to a polypeptide.

Examples of fusion proteins include, but are not limited to, fusions of a signal sequence, a tag such as for localization, e.g. a his$_6$ tag or a myc tag, or a tag for purification, for example, a GST fusion, and a sequence for directing protein secretion and/or membrane association.

In one embodiment, the FVII polypeptide or modified FVII polypeptides can be expressed in an active form, whereby activation is achieved by autoactivation of the polypeptide following secretion. In another embodiment, the protease is expressed in an inactive, zymogen form.

Methods of production of FVII polypeptides can include coexpression of one or more additional heterologous polypeptides that can aid in the generation of the FVII polypeptides. For example, such polypeptides can contribute to the post-translation processing of the FVII polypeptides. Exemplary polypeptides include, but are not limited to, peptidases that help cleave FVII precursor sequences, such as the propeptide sequence, and enzymes that participate in the modification of the FVII polypeptide, such as by glycosylation, hydroxylation, carboxylation, or phosphorylation, for example. An exemplary peptidase that can be coexpressed with FVII is PACE/furin (or PACE-SOL), which aids in the cleavage of the FVII propeptide sequence. An exemplary protein that aids in the carboxylation of the FVII polypeptide is the warfarin-sensitive enzyme vitamin K 2,3-epoxide reductase (VKOR), which produces reduced vitamin K for utilization as a cofactor by the vitamin K-dependent γ-carboxylase (Wajih et al., *J. Biol. Chem.* 280(36)31603-31607). A subunit of this enzyme, VKORC1, can be coexpressed with the modified FVII polypeptide to increase the γ-carboxylation The one or more additional polypeptides can be expressed from the same expression vector as the FVII polypeptide or from a different vector.

a. Prokaryotic Expression

Prokaryotes, especially *E. coli*, provide a system for producing large amounts of FVII (see, for example, Platis et al. (2003) Protein Exp. Purif. 31(2): 222-30; and Khalilzadeh et al. (2004) J. Ind. Microbiol. Biotechnol. 31(2): 63-69). Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λP$_L$ promoter.

FVII can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An alternative approach is the expression of FVII in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for FVII (see for example, Skoko et al. (2003) Biotechnol. Appl. Biochem. 38(Pt3):257-65). Yeast can be transformed with episomal replicating vectors or by stable chromosomal integration by homologous recombination. Typically, inducible promoters are used to regulate gene expression. Examples of such promoters include GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble and coexpression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (e.g., the Kex-2 protease) can be engineered to remove the fused sequences from the polypeptides as they exit the secretion pathway. Yeast also is capable of glycosylation at Asn-X-Ser/Thr motifs.

c. Insects and Insect Cells

Insects and insect cells, particularly using a baculovirus expression system, are useful for expressing polypeptides such as FVII or modified forms thereof (see, for example, Muneta et al. (2003) J. Vet. Med. Sci. 65(2):219-23). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express FVII polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-$\xi$ and Fc$_\epsilon$RI-$\gamma$ can direct expression of the proteins in an active state on the cell surface.

Many cell lines are available for mammalian expression including mouse, rat human, monkey, and chicken and hamster cells. Exemplary cell lines include, but are not limited to, BHK (i.e. BHK-21 cells), 293-F, CHO, Balb/3T3, HeLa, MT2, mouse NSO (non-secreting) and other myeloma cell lines, hybridoma and heterohybridoma cell lines, lymphocytes, fibroblasts, Sp2/0, COS, NIH3T3, HEK293, 293S, 293T, 2B8, and HKB cells. Cell lines also are available adapted to serum-free media which facilitates purification of secreted proteins from the cell culture media. One such example is the serum free EBNA-1 cell line (Pham et al., (2003) Biotechnol. Bioeng. 84:332-42). Expression of recombinant FVII polypeptides exhibiting similar structure and post-translational modifications as plasma-derived FVII are known in the art (see, e.g., Jurlander et al. (2001) Semin Throm Hemost 27:373-384). Methods of optimizing vitamin K-dependent protein expression are known. For example, supplementation of vitamin K in culture medium or co-expression of vitamin K-dependent γ-carboxylases (Wajih et al., J. Biol. Chem. 280(36)31603-31607) can aid in post-translational modification of vitamin K-dependent proteins, such as FVII polypeptides.

e. Plants

Transgenic plant cells and plants can be used for the expression of FVII. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Because plants have different glycosylation patterns than mammalian cells, this can influence the choice to produce FVII in these hosts. Transgenic plant cells also can include algae engineered to produce proteins (see, for example, Mayfield et al. (2003) PNAS 100:438-442). Because plants have different glycosylation patterns than mammalian cells, this can influence the choice to produce FVII in these hosts.

2. Purification

Methods for purification of FVII polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

FVII can be purified using standard protein purification techniques known in the art including but not limited to, SDS-PAGE, size fraction and size exclusion chromatography, ammonium sulfate precipitation, chelate chromatography and ionic exchange chromatography. For example, FVII polypeptides can be purified by anion exchange chromatography. Exemplary of a method to purify FVII polypeptides is by using an ion exchange column that permits binding of any polypeptide that has a functional Gla domain, followed by elution in the presence of calcium (See e.g., Example 2). Affinity purification techniques also can be used to improve the efficiency and purity of the preparations. For example, antibodies, receptors and other molecules that bind FVII can be used in affinity purification. In another example, purification also can be enhanced using a soluble TF (sTF) affinity column (Maun et al. (2005) Prot Sci 14:1171-1180). Expression constructs also can be engineered to add an affinity tag such as a myc epitope, GST fusion or His$_6$ and affinity purified with myc antibody, glutathione resin, and Ni-resin, respectively, to a protein. Purity can be assessed by any method known in the art including gel electrophoresis and staining and spectrophotometric techniques.

The FVII protease can be expressed and purified to be in an inactive form (zymogen form) or alternatively the expressed protease can be purified into an active form, such as by autocatalysis. For example, FVII polypeptides that have been activated via proteolytic cleavage of the Arg$^{152}$-Ile$^{153}$ can be prepared in vitro (i.e. FVIIa; two-chain form). The FVII polypeptides can be first prepared by any of the methods of production described herein, including, but not limited to, production in mammalian cells followed by purification. Cleavage of the FVII polypeptides into the active protease form, FVIIa, can be accomplished by several means. For example, autoactivation during incubation with phospholipid vesicles in the presence of calcium can be achieved in 45 minutes (Nelsestuen et al. (2001) J Biol Chem 276:39825-31). FVII polypeptides also can be activated to completion by incubation with factor Xa, factor XIIa or TF in the presence calcium, with or without phospholipids (see e.g., Example 2 and Broze et al. (1980) J Biol Chem 255:1242-1247, Higashi et al. (1996) J Biol Chem 271:26569-26574, Harvey et al. J Biol Chem 278:8363-8369).

3. Fusion Proteins

Fusion proteins containing a modified FVII polypeptide and one or more other polypeptides also are provided. Pharmaceutical compositions containing such fusion proteins formulated for administration by a suitable route are provided. Fusion proteins are formed by linking in any order the modified FVII polypeptide and an agent, such as an antibody or fragment thereof, growth factor, receptor, ligand, and other such agent for the purposes of facilitating the purification of a FVII polypeptide, altering the pharmacodynamic properties of a FVII polypeptide by directing, for example, by directing the polypeptide to a targeted cell or tissue, and/or increasing the expression or secretion of the FVII polypeptide. Typically any FVII fusion protein retains at least about 30%, 40%, 50%, 60%, 70%, 80%, 90%, or 95% coagulant activity compared with a non-fusion FVII polypeptide, including 96%, 97%, 98%, 99% or greater coagulant activity compared with a non-fusion polypeptide.

Linkage of a FVII polypeptide with another polypeptide can be effected directly or indirectly via a linker. In one example, linkage can be by chemical linkage, such as via heterobifunctional agents or thiol linkages or other such linkages. Fusion also can be effected by recombinant means. Fusion of a FVII polypeptide to another polypeptide can be to the N- or C-terminus of the FVII polypeptide. Non-limiting examples of polypeptides that can be used in fusion proteins with a FVII polypeptide provided herein include, for example, a GST (glutathione S-transferase) polypeptide, Fc domain from immunoglobulin G, or a heterologous signal sequence. The fusion proteins can contain additional components, such as E. coli maltose binding protein (MBP) that aid in uptake of the protein by cells (see, International PCT application No. WO 01/32711).

A fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A FVII-encoding nucleic acid can be cloned into such an expression vector such that the fusion moiety is linked in-frame to the protease protein.

4. Polypeptide Modification

Modified FVII polypeptides can be prepared as naked polypeptide chains or as a complex. For some applications, it can be desirable to prepare modified FVII in a "naked" form without post-translational or other chemical modifications. Naked polypeptide chains can be prepared in suitable hosts that do not post-translationally modify FVII. Such polypeptides also can be prepared in in vitro systems and using chemical polypeptide synthesis. For other applications, particular modifications can be desired including pegylation, albumination, glycosylation, carboxylation, hydroxylation, phosphorylation, or other known modifications. Modifications can be made in vitro or, for example, by producing the modified FVII in a suitable host that produces such modifications.

5. Nucleotide Sequences

Nucleic acid molecules encoding FVII or modified FVII polypeptides are provided herein. Nucleic acid molecules include allelic variants or splice variants of any encoded FVII polypeptide. Exemplary of nucleic acid molecules provided herein are any that encode a modified FVII polypeptide provided herein, such as any encoding a polypeptide set forth in any of SEQ ID NOS: 113-273. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoding a FVII polypeptide provided herein. In another embodiment, a nucleic acid molecule can include those with degenerate codon sequences encoding any of the FVII polypeptides provided herein.

F. Assessing Modified FVII Polypeptide Activities

The activities and properties of FVII polypeptides can be assessed in vitro and/or in vivo. Assays for such assessment are known to those of skill in the art and are known to correlate tested activities and results to therapeutic and in vivo activities. In one example, FVII variants can be assessed in comparison to unmodified and/or wild-type FVII. In another example, the activity of modified FVII polypeptides can be assessed following exposure in vitro or in vivo to AT-III and compared with that of modified FVII polypeptides that have not been exposed to AT-III. Such assays can be performed in the presence or absence of TF. In vitro assays include any laboratory assay known to one of skill in the art, such as for example, cell-based assays including coagulation assays, binding assays, protein assays, and molecular biology assays. In vivo assays include FVII assays in animal models as well as administration to humans. In some cases, activity of FVII in vivo can be determined by assessing blood, serum, or other bodily fluid for assay determinants. FVII variants also can be tested in vivo to assess an activity or property, such as therapeutic effect.

Typically, assays described herein are with respect to the two-chain activated form of FVII, i.e. FVIIa. Such assays also can be performed with the single chain form, such as to provide a negative control since such form typically does not contain proteolytic or catalytic activity required for the coagulant activity of FVII. In addition, such assays also can be performed in the presence of cofactors, such as TF, which in some instances augments the activity of FVII.

1. In Vitro Assays

Exemplary in vitro assays include assays to assess polypeptide modification and activity. Modifications can be assessed using in vitro assays that assess γ-carboxylation and other post-translational modifications, protein assays and conformational assays known in the art. Assays for activity include, but are not limited to, measurement of FVII interaction with other coagulation factors, such as TF, factor X and factor IX, proteolytic assays to determine the proteolytic activity of FVII polypeptides, assays to determine the binding and/or affinity of FVII polypeptides for phosphatidylserines and other phospholipids, and cell based assays to determine the effect of FVII polypeptides on coagulation.

Concentrations of modified FVII polypeptides can be assessed by methods well-known in the art, including but not limited to, enzyme-linked immunosorbant assays (ELISA), SDS-PAGE; Bradford, Lowry, BCA methods; UV absorbance, and other quantifiable protein labeling methods, such as, but not limited to, immunological, radioactive and fluorescent methods and related methods.

Assessment of cleavage products of proteolysis reactions, including cleavage of FVII polypeptides or products produced by FVII protease activity, can be performed using methods including, but not limited to, chromogenic substrate cleavage, HPLC, SDS-PAGE analysis, ELISA, Western blotting, immunohistochemistry, immunoprecipitation, NH2-terminal sequencing, and protein labeling.

Structural properties of modified FVII polypeptides can also be assessed. For example, X-ray crystallography, nuclear magnetic resonance (NMR), and cryoelectron microscopy (cryo-EM) of modified FVII polypeptides can be performed to assess three-dimensional structure of the FVII polypeptides and/or other properties of FVII polypeptides, such as $Ca^{2+}$ or cofactor binding.

Additionally, the presence and extent of FVII degradation can be measured by standard techniques such as sodium dodecyl sulfate polyacrylamide gel electrophoresis (SDS-PAGE), and Western blotting of electrophoresed FVII-containing samples. FVII polypeptides that have been exposed to proteases can also be subjected to N-terminal sequencing to determine location or changes in cleavage sites of the modified FVII polypeptides.

a. Post-Translational Modification

FVII polypeptides also can be assessed for the presence of post-translational modifications. Such assays are known in the art and include assays to measure glycosylation, hydroxylation, and carboxylation. In an exemplary assay for glycosylation, carbohydrate analysis can be performed, for example, with SDS page analysis of FVII polypeptides exposed to hydrazinolysis or endoglycosidase treatment. Hydrazinolysis releases N- and O-linked glycans from glycoproteins by incubation with anhydrous hydrazine, while endoglycosidase release involves PNGase F, which releases most N-glycans from glycoproteins. Hydrazinolysis or endoglycosidase treatment of FVII polypeptides generates a reducing terminus that can be tagged with a fluorophore or chromophore label. Labeled FVII polypeptides can be analyzed by fluorophore-assisted carbohydrate electrophoresis (FACE). The fluorescent tag for glycans also can be used for monosaccharide analysis, profiling or fingerprinting of complex glycosylation patterns by HPLC. Exemplary HPLC methods include hydrophilic interaction chromatography, electronic interaction, ion-exchange, hydrophobic interaction, and size-exclusion chromatography. Exemplary glycan probes include, but are not limited to, 3-(acetylamino)-6-aminoacridine (AA-Ac) and 2-aminobenzoic acid (2-AA). Carbohydrate moieties can also be detected through use of specific antibodies that recognize the glycosylated FVII polypeptide. An exemplary assay to measure β-hydroxylation comprises reverse phase HPLC analysis of FVII polypeptides that have been subjected to alkaline hydrolysis (Przysiecki et al. (1987) PNAS 84:7856-7860). Carboxylation and γ-carboxylation of FVII polypeptides can be assessed using mass spectrometry with matrix-assisted laser desorption ionization time-of-flight (MALDI-TOF) analysis, as described in the art (se, e.g. Harvey et al. J Biol Chem 278:8363-8369, Maun et al. Prot Sci 14:1171-1180). The interaction of a FVII polypeptide containing the propeptide (pro-FVII) with the carboxylase responsible for post-translational γ-carboxylate modification also can be assessed. The dissociation constant ($K_d$) following incubation of carboxylase with flourescin-labeled pro-FVII polypeptides can be measured by determining the amount of bound carboxylase by anisotropy (Lin et al. (2004) J Biol Chem 279:6560-6566).

b. Proteolytic Activity

Modified FVII polypeptides can be tested for proteolytic activity. The proteolytic activity of FVII can be measured using chromogenic substrates such as Chromozym t-PA ($MeSO_2$-D-Phe-Gly-Arg-pNA), S-2288 (H-D-Ile-Pro-Arg-pNA), S-2266 (H-D-Val-Leu-Arg-pNA), S-2765 (Z-D-Arg-Gly-Arg-pNA), Spectrozyme FXa and Spectrozyme FVIIa ($CH_3SO_2$-D-CHA-But-Arg-pNA). FVII polypeptides, alone or in the presence of TF, are incubated with varying concentrations of chromogenic substrate. Cleavage of the substrate can be monitored by absorbance and the rate of substrate hydrolysis determined by linear regression using software readily available.

The activation of coagulation factor substrates, such as FX, by FVII polypeptides also can be assessed. FVII polypeptides, with or without preincubation with TF, can be incubated with purified FX (available commercially). The amount of active FXa produced as a consequence of incubation with FVII polypeptides is measured as activity of FXa for a chromogenic substrate, such as S-2222 or Spectrafluor FXa ($CH_3SO_2$-D-CHA-Gly-Arg-AMC.AcOH), which is monitored via absorbance changes (Harvey et al. J Biol Chem 278:8363-8369, see also Example 4 below). A source of phospholipid also can be included in the incubation of FVII and FX (Nelsestuen et al. (2001) Biol Chem 276:39825-31).

c. Coagulation Activity

FVII polypeptides can be tested for coagulation activity by using assays well known in the art. For example, some of the assays include, but are not limited to, a two stage clotting assay (Liebman et al., (1985) PNAS 82:3879-3883); the prothrombin time assay (PT, which can measure TF-dependent activity of FVIIa in the extrinsic pathway); assays which are modifications of the PT test; the activated partial thromboplastin time (aPTT, which can measure TF-independent activity of FVIIa); activated clotting time (ACT); recalcified activated clotting time; the Lee-White Clotting time; or thromboelastography (TEG) (Pusateri et al. (2005) Critical Care 9:S15-S24). For example, coagulation activity of a modified FVII polypeptide can be determined by a PT-based assay where FVII is diluted in FVII-deficient plasma, and mixed with prothrombin time reagent (recombinant TF with phospholipids and calcium), such as that available as Innovin™ from Dade Behring. Clot formation is detected optically and time to clot is determined and compared against FVII-deficient plasma alone.

d. Binding to and/or Inhibition by Other Proteins and Molecules

Inhibition assays can be used to measure resistance of modified FVII polypeptides to FVII inhibitors, such as, for example, AT-III and TFPI, or molecules such as $Zn^{2+}$. Assessment of inhibition to other inhibitors also can be tested and include, but are not limited to, other serine protease inhibitors, and FVII-specific antibodies. Inhibition can be assessed by incubation of, for example, AT-III, TFPI or $Zn^{2+}$ with FVII polypeptides that have been preincubated with and/or without TF. The activity of FVII can then be measured using any one or more of the activity or coagulation assays described above, and inhibition by AT-III, TFPI, or $Zn^{2+}$ can be assessed by comparing the activity of FVII polypeptides incubated with the inhibitor, with the activity of FVII polypeptides that were not incubated with the inhibitor.

FVII polypeptides can be tested for binding to other coagulation factors and inhibitors. For example, FVII direct and indirect interactions with cofactors, such as TF, substrates, such as FX and FIX, and inhibitors, such as antithrombin III, TFPI, and heparin can be assessed using any binding assay known in the art, including, but not limited to, immunoprecipitation, column purification, non-reducing SDS-PAGE, BIAcore® assays, surface plasmon resonance (SPR), fluorescence resonance energy transfer (FRET), fluorescence polarization (FP), isothermal titration calorimetry (ITC), circular dichroism (CD), protein fragment complementation assays (PCA), Nuclear Magnetic Resonance (NMR) spectroscopy, light scattering, sedimentation equilibrium, small-zone gel filtration chromatography, gel retardation, Far-western blotting, fluorescence polarization, hydroxyl-radical protein footprinting, phage display, and various two-hybrid systems. In one example, $Zn^{2+}$ binding is assessed using equilibrium analysis (Petersen et al., (2000) Protein Science 9:859-866)

e. Phospholipid Affinity

Modified FVII polypeptide binding and/or affinity for phosphatidylserine (PS) and other phospholipids can be determined using assays well known in the art. Highly pure phospholipids (for example, known concentrations of bovine PS and egg phosphatidylcholine (PC), which are commercially available, such as from Sigma, in organic solvent can be used to prepare small unilamellar phospholipid vesicles. FVII polypeptide binding to these PS/PC vesicles can be determined by relative light scattering at 900 to the incident light. The intensity of the light scatter with PC/PS alone and with PC/PS/FVII is measured to determine the dissociation constant (Harvey et al. J Biol Chem 278:8363-8369). Surface plasma resonance, such as on a BIAcore biosensor instrument, also can be used to measure the affinity of FVII polypeptides for phospholipid membranes (Sun et al. Blood 101:2277-2284).

2. Non-Human Animal Models

Non-human animal models can be used to assess activity, efficacy and safety of modified FVII polypeptides. For example, non-human animals can be used as models for a disease or condition. Non-human animals can be injected with disease and/or phenotype-inducing substances prior to administration of FVII variants, such as any FVII variant set forth in any of SEQ ID NOS: 113-273, to monitor the effects on disease progression. Genetic models also are useful. Animals, such as mice, can be generated which mimic a disease or condition by the overexpression, underexpression or knock-out of one or more genes, such as, for example, factor VIII knock-out mice that display hemophilia A (Bi et al. (1995) Nat Gen 10:119-121). Such animals can be generated by transgenic animal production techniques well-known in the art or using naturally-occurring or induced mutant strains. Examples of useful non-human animal models of diseases associated with FVII include, but are not limited to, models of bleeding disorders, in particular hemophilia, or thrombotic disease. Non-human animal models for injury also can be used to assess an activity, such as the coagulation activity, of FVII polypeptides. These non-human animal models can be used to monitor activity of FVII variants compared to a wild type FVII polypeptide.

Animal models also can be used to monitor stability, half-life, and clearance of modified FVII polypeptides. Such assays are useful for comparing modified FVII polypeptides and for calculating doses and dose regimens for further non-human animal and human trials. For example, a modified FVII polypeptide, such as any FVII variant provided herein including, for example, any set forth in any of SEQ ID NOS: 113-273, can be injected into the tail vein of mice. Blood samples are then taken at time-points after injection (such as minutes, hours and days afterwards) and then the level of the modified FVII polypeptides in bodily samples including, but not limited to, serum or plasma can be monitored at specific time-points for example by ELISA or radioimmunoassay. Blood samples from various time points following injection of the FVII polypeptides also be tested for coagulation activity using various methods, such as is described in Example 9. These types of pharmacokinetic studies can provide information regarding half-life, clearance and stability of the FVII polypeptides, which can assist in determining suitable dosages for administration as a procoagulant.

Modified FVII polypeptides, such as any set forth in any of SEQ ID NOS: 113-273, can be tested for therapeutic effectiveness using animal models for hemophilia. In one non-limiting example, an animal model such as a mouse can be used. Mouse models of hemophilia are available in the art and can be employed to test modified FVII polypeptides. For example, a mouse model of hemophilia A that is produced by injection with anti-FVIII antibodies can be used to assess the coagulant activity of FVII polypeptides (see e.g. Example 6, and Tranholm et al. Blood (2003)102:3615-3620). A mouse model of hemophilia B also can be used to test FVII polypeptides (Margaritis et al. (2004) J Clin Invest 113:1025-1031). Non-mouse models of bleeding disorders also exist. FVII polypeptide activity can be assessed in rats with warfarin-induced bleeding or melagatran-induced bleeding (Diness et al. (1992) Thromb Res 67:233-241, Elg et al. (2001) Thromb Res 101:145-157), and rabbits with heparin-induced bleeding (Chan et al. (2003) J Thromb Haemost 1:760-765). Inbred hemophilia A, hemophilia B and von Willebrand disease dogs that display severe bleeding also can be used in non-human animal studies with FVII polypeptides (Brinkhous et al. (1989) PNAS 86:1382-1386). The activity of FVII polypeptides also can be assessed in a rabbit model of bleeding in which thrombocytopenia is induced by a combination of gamma-irradiation and the use of platelet antibodies (Tranholm et al. (2003) Thromb Res 109:217-223).

In addition to animals with generalized bleeding disorders, injury and trauma models also can be used to evaluate the activity of FVII polypeptides, and their safety and efficacy as a coagulant therapeutic. Non-limiting examples of such models include a rabbit coronary stenosis model (Fatorutto et al. (2004) Can J Anaesth 51:672-679), a grade V liver injury model in pigs (Lynn et al. (2002) J Trauma 52:703-707), a grade V liver injury model in pigs (Martinowitz et al. (2001) J Trauma 50:721-729) and a pig aortotomy model (Sondeen et al. (2004) Shock 22:163-168).

3. Clinical Assays

Many assays are available to assess activity of FVII for clinical use. Such assays can include assessment of coagulation, protein stability and half-life in vivo, and phenotypic assays. Phenotypic assays and assays to assess the therapeutic effect of FVII treatment include assessment of blood levels of FVII (e.g. measurement of serum FVII prior to administration and time-points following administrations including, after the first administration, immediately after last administration, and time-points in between, correcting for the body mass index (BMI)), assessment of blood coagulation in vitro using the methods described above following treatment with FVII (e.g. PT assay), and phenotypic response to FVII treatment including amelioration of symptoms over time compared to subjects treated with an unmodified and/or wild type FVII or placebo. Patients treated with FVII polypeptides can be monitored for blood loss, transfusion requirement, and hemoglobin. Patients can be monitored regularly over a period of time for routine or repeated administrations, or following administration in response to acute events, such as hemorrhage, trauma, or surgical procedures.

G. Formulation and Administration

Compositions for use in treatment of bleeding disorders are provided herein. Such compositions contain a therapeutically effective amount of a factor VII polypeptide as described herein. Effective concentrations of FVII polypeptides or pharmaceutically acceptable derivatives thereof are mixed with a suitable pharmaceutical carrier or vehicle for systemic, topical or local administration. Compounds are included in an amount effective for treating the selected disorder. The concentration of active compound in the composition will depend on absorption, inactivation, excretion rates of the active compound, the dosage schedule, and amount administered as well as other factors known to those of skill in the art.

Pharmaceutical carriers or vehicles suitable for administration of the compounds provided herein include any such carriers known to those skilled in the art to be suitable for the particular mode of administration. Pharmaceutical compositions that include a therapeutically effective amount of a FVII polypeptide described herein also can be provided as a lyophilized powder that is reconstituted, such as with sterile water, immediately prior to administration.

1. Formulations

Pharmaceutical compositions containing a modified FVII can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical, or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed, or otherwise mixed in a selected vehicle at an effective concentration such that the treated condition is relieved or ameliorated.

The modified FVII polypeptides provided herein can be formulated for administration to a subject as a two-chain FVIIa protein. The modified FVII polypeptides can be activated by any method known in the art prior to formulation. For example, FVII can undergo autoactivation during purification by ion exchange chromatography (Jurlander et al. (2001) Semin Thromb Hemost 27:373-384). The modified FVII polypeptides also can be activated by incubation with FXa immobilized on beads (Kemball-Cook et al. (1998) J Biol Chem 273:8516-8521), or any other methods known in the art (see also Example 2 below). The inclusion of calcium in these processes ensures full activation and correct folding of the modified FVIIa protein. The modified FVII polypeptides provided herein also can be formulated for administration as a single chain protein. The single-chain FVII polypeptides can be purified in such a way as to prevent cleavage (see, e.g., U.S. Pat. No. 6,677,440). The modified FVII polypeptides provided herein can be formulated such that the single-chain and two-chain forms are contained in the pharmaceutical composition, in any ratio by appropriate selection of the medium to eliminate or control autoactivation.

The compound can be suspended in micronized or other suitable form or can be derivatized to produce a more soluble active product. The form of the resulting mixture depends upon a number of factors, including the intended mode of administration and the solubility of the compound in the selected carrier or vehicle. The resulting mixtures are solutions, suspensions, emulsions and other such mixtures, and can be formulated as an non-aqueous or aqueous mixture, creams, gels, ointments, emulsions, solutions, elixirs, lotions, suspensions, tinctures, pastes, foams, aerosols, irrigations, sprays, suppositories, bandages, or any other formulation suitable for systemic, topical or local administration. For local internal administration, such as, intramuscular, parenteral or intra-articular administration, the polypeptides can be formulated as a solution suspension in an aqueous-based medium, such as isotonically buffered saline or are combined with a biocompatible support or bioadhesive intended for internal administration. The effective concentration is sufficient for ameliorating the targeted condition and can be empirically determined. To formulate a composition, the weight fraction of compound is dissolved, suspended, dispersed, or otherwise mixed in a selected vehicle at an effective concentration such that the targeted condition is relieved or ameliorated.

Generally, pharmaceutically acceptable compositions are prepared in view of approvals for a regulatory agency or other prepared in accordance with generally recognized pharmacopeia for use in animals and in humans. Pharmaceutical compositions can include carriers such as a diluent, adjuvant, excipient, or vehicle with which an isoform is administered. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acaciagelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents. These compositions can take the form of solutions, suspensions, emulsion, tablets, pills, capsules, powders, and sustained release formulations. Capsules and cartridges of e.g., gelatin for use in an inhaler or insufflator can be formulated containing a powder mix of a therapeutic compound and a suitable powder base such as lactose or starch. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. Preparations for oral administration also can be suitably formulated with protease inhibitors, such as a Bowman-Birk inhibitor, a conjugated Bowman- Birk inhibitor, aprotinin and camostat. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to a subject or patient.

The formulation should suit the mode of administration. For example, the modified FVII can be formulated for parenteral administration by injection (e.g., by bolus injection or continuous infusion). The injectable compositions can take such forms as suspensions, solutions or emulsions in oily or aqueous vehicles. The sterile injectable preparation also can be a sterile injectable solution or suspension in a non-toxic parenterally-acceptable diluent or solvent, for example, as a solution in 1,4-butanediol. Sterile, fixed oils are conventionally employed as a solvent or suspending medium. For this purpose any bland fixed oil can be employed, including, but not limited to, synthetic mono- or diglycerides, fatty acids (including oleic acid), naturally occurring vegetable oils like sesame oil, coconut oil, peanut oil, cottonseed oil, and other oils, or synthetic fatty vehicles like ethyl oleate. Buffers, preservatives, antioxidants, and the suitable ingredients, can be incorporated as required, or, alternatively, can comprise the formulation.

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) J Pharm Sci. 74(9): 922-5). The compositions provided herein further can contain one or more adjuvants that facilitate delivery, such as, but are not limited to, inert carriers, or colloidal dispersion systems. Representative and non-limiting examples of such inert carriers can be selected from water, isopropyl alcohol, gaseous fluorocarbons, ethyl alcohol, polyvinyl pyrrolidone, propylene glycol, a gel-producing material, stearyl alcohol, stearic acid, spermaceti, sorbitan monooleate, methylcellulose, as well as suitable combinations of two or more thereof. The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

a. Dosages

The precise amount or dose of the therapeutic agent administered depends on the particular FVII polypeptide, the route of administration, and other considerations, such as the severity of the disease and the weight and general state of the subject. Local administration of the therapeutic agent will typically require a smaller dosage than any mode of systemic administration, although the local concentration of the therapeutic agent can, in some cases, be higher following local administration than can be achieved with safety upon systemic administration. If necessary, a particular dosage and duration and treatment protocol can be empirically determined or extrapolated. For example, exemplary doses of recombinant and native FVII polypeptides can be used as a starting point to determine appropriate dosages. For example, a recombinant FVII (rFVIIa) polypeptide that has been activated to rFVIIa, Novoseven®, has been administered to patients with hemophilia A or hemophilia B, who are experiencing a bleeding episode, at a dosage of 90 µg/kg by bolus infusion over 2 to 5 minutes, achieving an effective circulating level of at least 2 µg/ml. The dose is repeated every 2 hours until hemostasis is achieved. The modified FVII polypeptides provided herein can be effective at reduced dosage amounts and/or frequencies compared to such a recombinant FVII. For example, at the modified FVII polypeptides provided herein can be administered at a dosage of 80 µg/kg, 70 µg/kg, 60 µg/kg, 50 µg/kg, 40 µg/kg, 30 µg/kg, 20 µg/kg, 15 µg/kg or less. In some embodiments, the dosages can be higher, such as 100 µg/kg, 110 µg/kg, 120 µg/kg, or higher. The duration of treatment and the interval between injections will vary with the severity of the bleed and the response of the patient to the treatment, and can be adjusted accordingly. Factors such as the level of activity and half-life of the modified FVII in comparison to the unmodified FVII can be taken into account when making dosage determinations. Particular dosages and regimens can be empirically determined.

In another example, a recombinant FVII (rFVIIa) polypeptide that has been activated to rFVIIa, Novoseven®, has been administered to patients with congenital FVII deficiency who are experiencing a bleeding episode, at a dosage of 15-30 µg/kg by bolus infusion over 2 to 5 minutes. The dose is repeated every 4-6 hours until hemostasis is achieved. The modified FVII polypeptides provided herein can be effective at reduced dosage amounts and/or frequencies compared to such a recombinant FVII. For example, the modified FVII polypeptides provided herein can be administered at a dosage of 20 µg/kg, 15 µg/kg, 10 µg/kg, 5 µg/kg, 3 µg/kg or less. In some examples, the dosages can be higher, such as 35 µg/kg, 40 µg/kg, 45 µg/kg, or higher. The duration of treatment and the interval between injections will vary with the severity of the bleed and the response of the patient to the treatment, and can be adjusted accordingly. Factors such as the level of activity and half-life of the modified FVII in comparison to the unmodified FVII can be used in making dosage determinations. For example, a modified FVII polypeptide that exhibits a longer half-life than an unmodified FVII polypeptide can be administered at lower doses and/or less frequently than the unmodified FVII polypeptide. Similarly, the dosages required for therapeutic effect using a modified FVII polypeptide that displays increased coagulant activity compared with an unmodified FVII polypeptide can be reduced in frequency and amount. Particular dosages and regimens can be empirically determined by one of skill in the art.

b. Dosage Forms

Pharmaceutical therapeutically active compounds and derivatives thereof are typically formulated and administered in unit dosage forms or multiple dosage forms. Formulations can be provided for administration to humans and animals in dosage forms that include, but are not limited to, tablets, capsules, pills, powders, granules, sterile parenteral solutions or suspensions, oral solutions or suspensions, and oil water emulsions containing suitable quantities of the compounds or pharmaceutically acceptable derivatives thereof. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. In some examples, the unit dose is provided as a lyophilized powder that is reconstituted prior to administration. For example, a FVII polypeptide can be provided as lyophilized powder that is reconstituted with a suitable solution to generate a single dose solution for injection. In some embodiments, the lyophilized powder can contain the FVII polypeptide and additional components, such as salts, such that reconstitution with sterile distilled water results in a FVII polypeptide in a buffered or saline solution. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging.

2. Administration of Modified FVII Polypeptides

The FVII polypeptides provided herein (i.e. active compounds) can be administered in vitro, ex vivo, or in vivo by contacting a mixture, such as a body fluid or other tissue sample, with a FVII polypeptide. For example, when administering a compound ex vivo, a body fluid or tissue sample from a subject can be contacted with the FVII polypeptides that are coated on a tube or filter, such as for example, a tube or filter in a bypass machine. When administering in vivo, the active compounds can be administered by any appropriate route, for example, orally, nasally, pulmonary, parenterally, intravenously, intradermally, subcutaneously, intraarticularly, intracisternally, intraocularly, intraventricularly, intrathecally, intramuscularly, intraperitoneally, intratracheally or topically, as well as by any combination of any two or more thereof, in liquid, semi-liquid or solid form and are formulated in a manner suitable for each route of administration. The modified FVII polypeptides can be administered once or more than once, such as twice, three times, four times, or any number of times that are required to achieve a therapeutic effect. Multiple administrations can be effected via any route or combination of routes, and can be administered hourly, every 2 hours, every three hours, every four hours or more.

The most suitable route for administration will vary depending upon the disease state to be treated, for example the location of the bleeding disorder. Generally, the FVII polypeptides will be administered by intravenous bolus injection, with an administration (infusing) time of approximately 2-5 minutes. In other examples, desirable blood levels of FVII can be maintained by a continuous infusion of the active agent as ascertained by plasma levels. It should be noted that the attending physician would know how to and when to terminate, interrupt or adjust therapy to lower dosage due to toxicity, or bone marrow, liver or kidney dysfunctions. Conversely, the attending physician would also know how to and when to adjust treatment to higher levels if the clinical response is not adequate (precluding toxic side effects). In other examples, the location of the bleeding disorder might indicate that the FVII formulation is administered via alternative routes. For example, local administration, including administration into the brain (e.g., intraventricularly) might be performed when the patient is experiencing bleeding in this region. Similarly, for treatment of bleeding in the joints, local administration by injection of the therapeutic agent into the joint (i.e., intraarticularly, intravenous or subcutaneous means) can be employed. In other examples, topical administration of the therapeutic agent to the skin, for example formulated as a cream, gel, or ointment, or administration to the lungs by inhalation or intratracheally, might be appropriate when the bleeding is localized to these areas.

The instances where the modified FVII polypeptides are be formulated as a depot preparation, the long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The compositions, if desired, can be presented in a package, in a kit or dispenser device, that can contain one or more unit dosage forms containing the active ingredient. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

3. Administration of Nucleic Acids Encoding Modified FVII Polypeptides (Gene Therapy)

Also provided are compositions of nucleic acid molecules encoding the modified FVII polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

Modified FVII polypeptides can be delivered to cells and tissues by expression of nucleic acid molecules. Modified FVII polypeptides can be administered as nucleic acid molecules encoding modified FVII polypeptides, including ex vivo techniques and direct in vivo expression. Nucleic acids can be delivered to cells and tissues by any method known to those of skill in the art. The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

Methods for administering modified FVII polypeptides by expression of encoding nucleic acid molecules include administration of recombinant vectors. The vector can be designed to remain episomal, such as by inclusion of an origin of replication or can be designed to integrate into a chromosome in the cell. Modified FVII polypeptides also can be used in ex vivo gene expression therapy using non-viral vectors. For example, cells can be engineered to express a modified FVII polypeptide, such as by integrating a modified FVII polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Viral vectors, include, for example adenoviruses, adeno-associated viruses (AAV), poxviruses, herpes viruses, retroviruses and others designed for gene therapy can be employed. The vectors can remain episomal or can integrate into chromosomes of the treated subject. A modified FVII polypeptide can be expressed by a virus, which is administered to a subject in need of treatment. Viral vectors suitable for gene therapy include adenovirus, adeno-associated virus (AAV), retroviruses, lentiviruses, vaccinia viruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a modified FVII polypeptide-expressing adenovirus vector. After a suitable culturing period, the transduced cells are administered to a subject, locally and/or systemically. Alternatively, modified FVII polypeptide-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to $10^{14}$ particles per kilogram subject weight, generally between $10^6$ or $10^8$ particles to $10^{12}$ particles per kilogram subject weight. In some situations it is desirable to provide a nucleic acid source with an agent that targets cells, such as an antibody specific for a cell surface membrane protein or a target cell, or a ligand for a receptor on a target cell. FVII also can be targeted for delivery into specific cell types. For example, adenoviral vectors encoding FVII polypeptides can be used for stable expression in nondividing cells, such as liver cells (Margaritis et al. (2004) J Clin Invest 113:1025-1031). In another example, viral or nonviral vectors encoding FVII polypeptides can be transduced into isolated cells for subsequent delivery. Additional cell types for expression and delivery of FVII might include, but are not limited to, fibroblasts and endothelial cells.

The nucleic acid molecules can be introduced into artificial chromosomes and other non-viral vectors. Artificial chromosomes, such as ACES (see, Lindenbaum et al. (2004) Nucleic Acids Res. 32(21):e172) can be engineered to encode and express the isoform. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression (ACE) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified FVII polypeptides is a two-step gene replacement technique in yeast, starting with a complete adenovirus genome (Ad2; Ketner et al. (1994) PNAS 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified FVII polypeptides for gene transfer to mammalian cells or whole animals.

The nucleic acids can be encapsulated in a vehicle, such as a liposome, or introduced into a cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g. capsid proteins or fragments thereof tropic for a particular cell type, antibodies for proteins which undergo internalization in cycling, and proteins that target intracellular localization and enhance intracellular half-life.

For ex vivo and in vivo methods, nucleic acid molecules encoding the modified FVII polypeptide is introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or the subject to be treated cells are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187 each of which is herein incorporated by reference in its entirety). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express modified FVII polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a modified FVII polypeptide can be linked to expression of additional molecules. For example, expression of a modified FVII polypeptide can be linked with expression of a cytotoxic product such as in an engineered virus or expressed in a cytotoxic virus. Such viruses can be targeted to a particular cell type that is a target for a therapeutic effect. The expressed modified FVII polypeptide can be used to enhance the cytotoxicity of the virus.

In vivo expression of a modified FVII polypeptide can include operatively linking a modified FVII polypeptide encoding nucleic acid molecule to specific regulatory sequences such as a cell-specific or tissue-specific promoter. Modified FVII polypeptides also can be expressed from vectors that specifically infect and/or replicate in target cell types and/or tissues. Inducible promoters can be use to selectively regulate modified FVII polypeptide expression. An exemplary regulatable expression system is the doxycycline-inducible gene expression system, which has been used to regulate recombinant FVII expression (Srour et al. (2003) Thromb Haemost. 90(3): 398-405).

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating can be targeted cells for in vivo expression of modified FVII polypeptides. Cells used for in vivo expression of an modified FVII polypeptide also include cells autologous to the patient. Such cells can be removed from a patient, nucleic acids for expression of an modified FVII polypeptide introduced, and then administered to a patient such as by injection or engraftment.

H. Therapeutic Uses

The modified FVII polypeptides provided herein can be used for treatment of any condition for which recombinant FVII is employed. Typically, such treatments include those where increased coagulation, such as increased hemostatic responses, are desired. Modified FVII polypeptides have therapeutic activity alone or in combination with other agents. The modified polypeptides provided herein are designed to retain therapeutic activity but exhibit modified properties, particularly increased resistance to AT-III and increased catalytic activity. The modified polypeptides provided herein also can exhibit increased resistance to TFPI, increased resistance to the inhibitory effects of $Zn^{2+}$, improved pharmacokinetic properties, such as serum half-life, increased binding and/or affinity for activated platelets, increased binding and/or affinity for serum albumin, and/or increased binding and/or affinity for platelet integrin $\alpha_{IIb}\beta_3$. Such modified properties, for example, can improve the therapeutic effectiveness of the polypeptides due to increased coagulant activity of the modified FVII polypeptides. This section provides exemplary uses of and administration methods. These described therapies are exemplary and do not limit the applications of modified FVII polypeptides.

The modified FVII polypeptides provided herein can be used in various therapeutic as well as diagnostic methods in which FVII is employed. Such methods include, but are not limited to, methods of treatment of physiological and medical conditions described and listed below. Modified FVII polypeptides provided herein can exhibit improvement of in vivo activities and therapeutic effects compared to wild-type FVII, including lower dosage to achieve the same effect, and other improvements in administration and treatment such as fewer and/or less frequent administrations, decreased side effects and increased therapeutic effects. Although it is understood that the modified FVII polypeptides can be administered as a FVII zymogen (i.e. single chain form), typically the modified FVII polypeptides provided herein are administered in activated two-chain form following, for example, autoactivation or activation by other coagulation factors, such as during purification.

In particular, modified FVII polypeptides are intended for use in therapeutic methods in which FVII has been used for treatment. Such methods include, but are not limited to, methods of treatment of diseases and disorders, such as, but not limited to, blood coagulation disorders, hematologic disorders, hemorrhagic disorders, hemophilias, such as hemophilia A, hemophilia B and factor VII deficiency, and acquired blood disorders, such as acquired factor VII deficiency caused by liver disease. Modified FVII polypeptides also can be used in the treatment of additional bleeding diseases and disorders, such as, but not limited to, thrombocytopenia (e.g., such as due to chemotherapeutic regimes), Von Willebrand's disease, hereditary platelet disorders (e.g., storage pool disease such as Chediak-Higashi and Hermansky-Pudlak syndromes, thromboxane A2 dysfunction, Glanzmann's thrombasthenia, and Bernard-Soulier syndrome), hemolytic-uremic syndrome, Hereditary Hemorrhagic Telangiectsasia, also known as Rendu-Osler-Weber syndrome, allergic purpura (Henoch Schonlein purpura) and disseminated intravascular coagulation.

In some embodiments, the bleedings to be treated by FVII polypeptides occur in organs such as the brain, inner ear region, eyes, liver, lung, tumor tissue, gastrointestinal tract. In other embodiments, the bleeding is diffuse, such as in haemorrhagic gastritis and profuse uterine bleeding. Patients with bleeding disorders, such as for example, hemophilia A and B, often are at risk of bleeding complications during surgery or trauma. Such bleeding can be manifested as acute haemarthroses (bleedings in joints), chronic hemophilic arthropathy, haematomas, (e.g., muscular, retroperitoneal, sublingual and retropharyngeal), haematuria (bleeding from the renal tract), central nervous system bleedings, gastrointestinal bleedings (e.g., UGI bleeds) and cerebral hemorrhage, which also can be treated with modified FVII polypeptides. Additionally, any bleeding associated with surgery (e.g., hepatectomy), or dental extraction can be treated with modified FVII polypeptides. In one embodiment, the modified FVII polypeptides can be used to treat bleeding episodes due to trauma, or surgery, or lowered count or activity of platelets, in a subject. Exemplary methods for patients undergoing surgery include treatments to prevent hemorrhage and treatments before, during, or after surgeries such as, but not limited to, heart surgery, angioplasty, lung surgery, abdominal surgery, spinal surgery, brain surgery, vascular surgery, dental surgery, or organ transplant surgery, including transplantation of bone marrow, heart, lung, pancreas, or liver.

Treatment of diseases and conditions with modified FVII polypeptides can be effected by any suitable route of administration using suitable formulations as described herein including, but not limited to, injection, pulmonary, oral and transdermal administration. Treatment typically is effected by intravenous bolus administration.

If necessary, a particular dosage and duration and treatment protocol can be empirically determined or extrapolated. For example, exemplary doses of recombinant and native FVII polypeptides can be used as a starting point to determine appropriate dosages. For example, a recombinant FVII (rFVIIa) polypeptide that has been activated to rFVIIa, Novoseven®, has been administered to patients with hemophilia A or hemophilia B, who are experiencing a bleeding episode, at a dosage of 90 µg/kg by bolus infusion over 2 to 5 minutes, achieving an effective circulating level of at least 2 µg/ml, with a mean half-life of 2.7 hours. The dose is repeated every 2 hours until hemostasis is achieved. Modified FVII polypeptides that are have an increased coagulant activity, due to, for example, increased resistance to AT-III, increased catalytic activity, increased resistance to the inhibitory effects of $Zn^{2+}$, increased resistance to TFPI, improved pharmacokinetic properties, such as increased serum half-life, increased binding and/or affinity for activated platelets, increased binding and/or affinity for serum albumin, and/or increased binding and/or affinity for platelet integrin $\alpha_{IIb}\beta_3$, can be effective at reduced dosage amounts and/or frequencies compared to such a recombinant FVII. Dosages for wild-type or unmodified FVII polypeptides can be used as guidance for determining dosages for modified FVII polypeptides. Factors such as the level of activity and half-life of the modified FVII in comparison to the unmodified FVII can be used in making such determinations. Particular dosages and regimens can be empirically determined.

Dosage levels and regimens can be determined based upon known dosages and regimens, and, if necessary can be extrapolated based upon the changes in properties of the modified polypeptides and/or can be determined empirically based on a variety of factors. Such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the polypeptide, typically is combined with a pharmaceutically effective carrier. The amount of active ingredient that can be combined with the carrier materials to produce a single dosage form or multi-dosage form can vary depending upon the host treated and the particular mode of administration.

The effect of the FVII polypeptides on the clotting time of blood can be monitored using any of the clotting tests known in the art including, but not limited to, whole blood prothrombin time (PT), the activated partial thromboplastin time (aPTT), the activated clotting time (ACT), the recalcified activated clotting time, or the Lee-White Clotting time.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures.

The following are some exemplary conditions for which FVII (administered as FVIIa) has been used as a treatment agent alone or in combination with other agents.

1. Congenital Bleeding Disorders a. Hemophilia

Congenital hemophilia is a recessive blood disorder in which there are decreased levels of coagulation factors in the plasma, leading to disruption of the coagulation cascade and increased blot clotting time. Hemophilia A, which accounts for approximately 85% of all cases of hemophilia, results from mutations(s) in the factor VIII gene on the X chromosome, leading to a deficiency or dysfunction of the FVIII protein. Hemophilia B is caused by a deficiency or dysfunction of the coagulation factor, FIX, generally resulting from point mutations or deletions in the FIX gene on X chromosome. The worldwide incidence of hemophilia A is approximately 1 case per 5000 male individuals, and 1 case per 25000 males for hemophilia B. Hemophilia A and B are further classified as mild, moderate, or severe. A plasma level with 5%-25% of normally functioning factor VIII or IX is classified as mild, 1%-5% is moderate, and less that 1% is severe. Hemophilia C, often referred to as FIX deficiency, is a relatively mild and rare disease, affecting about 1 in 100000 people in an autosomal recessive manner.

Hemophilia A and B manifests clinically in many ways. Minor cuts and abrasions will not result in excessive bleeding, but traumas and surgeries will. The patient also will have numerous joint and muscle bleeds and easy bruising. Hemarthrosis or bleeding into the joints is one of the major complications in hemophilia, and can occur spontaneously or in response to trauma. The hinge joints, such as the knee, elbow and ankle, are affected most frequently. The hip and shoulder are affected much less frequently as the ball and socket joint have more musculature surrounding them, thus protecting them more from injury. The bleeding can cause severe acute pain, restrict movement, and lead to secondary complications including synovial hypertrophy. Furthermore, the recurring bleeding in the joints can cause chronic synovitis, which can cause joint damage, destroying synovium, cartilage, and bone. Life-threatening hemorrhages, such as intracranial hemorrhage and bleeding in the central nervous system, also afflicts hemophilic subjects. Intracranial bleeding occurs in approximately 10% of patients with sever hemophilia, resulting in a 30% mortality rate. In contrast, Hemophilia C is more mild. Spontaneous bleeds are rarely seen, and bleeding into joints, soft tissues and muscles also is uncommon. Bleeding is generally treated with transfusion of fresh frozen plasma (FFP), FXI replacement therapy, or, for topical treatment, such treatment of external wounds or dental extractions, fibrin glue.

The most common treatment for hemophilia A or B is replacement therapy, in which the patient is administered FVIII or FIX. The formulations are available commercially as plasma-derived or recombinant products, with recombinant proteins now being the treatment of choice in previously untreated patients. While these therapies can be very successful, complications arise if the patient develops inhibitors to the newly administered factor VIII or factor IX. Inhibitors are IgG antibodies, mostly of the IgG4 subclass, that react with FVIII or FIX and interfere with pro-coagulant function. Inhibitors affect about 1 in 5 patients with severe hemophilia A. Most subjects develop these inhibitors soon after administration of the first infusions of factor VIII, which is often in early childhood, although subjects develop them later in life. Inhibitors also affect about 1 in 15 people with mild or moderate hemophilia A. These inhibitors usually develop during adulthood and not only destroy administered exogenous FVIII, but also destroy endogenous FVIII. As a result, mild and moderate hemophiliacs become severe. Clinically, hemophilia A patients with inhibitors are classified into high and low responders according to the strength of the anamnestic response they experience when they are re-exposed to FVIII. Inhibitors affect about 1 in 100 patients with hemophilia B. In most cases, the inhibitors develop after the first infusions of therapeutic factor IX and can be accompanied by allergic reactions.

The modified FVII polypeptides presented herein can be used to treat patients with hemophilia, particularly hemophilia patients with inhibitors. A recombinant FVIIa product (NovoSeven, Novo Nordisk) has been approved and licensed for the treatment of bleeding episodes in hemophilia A or B patients with inhibitors to FVIII or FIX and for the prevention of bleeding in surgical interventions or invasive procedures in hemophilia A or B patients with inhibitors to FVIII or FIX. Treatment with rFVIIa enhances thrombin generation while bypassing the requirement for FVIIIa and/or FIXa. Coagulation is initiated at the site of injury by the interaction of rFVIIa with TF, resulting in initial FX activation, thrombin generation, and activation of platelets. Complete coagulation by rFVIIa is can be effected by the TF-dependent and TF-independent mechanisms, where some of the thrombin generated can result from the direct activation of FX on activated platelets by rFVIIa alone, which itself binds activated platelets through low affinity interactions with the phospholipid membranes.

The modified FVII polypeptides provided herein can be used in therapies for hemophilia, including the treatment of bleeding episodes and the prevention of bleeding in surgical interventions or invasive procedures. The modified FVII polypeptides herein can provide increased resistance to AT-III, increased catalytic activity, increased resistance to the inhibitory effects of $Zn^{2+}$, increased resistance to TFPI, improved pharmacokinetic properties, such as serum half-life, increased binding and/or affinity for activated platelets, increased binding and/or affinity for serum albumin, and/or increased binding and/or affinity for platelet integrin $\alpha_{IIb}\beta_3$. The FVII polypeptides can therefore display higher coagulant activity in a TF-dependent manner (such as through increased resistance to TFPI), and/or a TF-independent manner (such as through increased binding and/or affinity for activated platelets). Thus, the modified FVII polypeptides can be used to deliver more active therapies for hemophilia. Examples of therapeutic improvements using modified FVII polypeptides include for example, but are not limited to, lower dosages, fewer and/or less frequent administrations, decreased side effects, and increased therapeutic effects.

The modified FVII polypeptides typically are administered as activated FVII (FVIIa) polypeptides. Modified FVII polypeptides can be tested for therapeutic effectiveness, for example, by using animal models. For example antibody-induced hemophilic mice, or any other known disease model for hemophilia, can be treated with modified FVII polypeptides. Progression of disease symptoms and phenotypes is monitored to assess the effects of the modified FVII polypeptides. Modified FVII polypeptides also can be administered to subjects such as in clinical trials to assess in vivo effectiveness in comparison to placebo controls and/or controls using unmodified FVII.

b. FVII Deficiency

Factor VII deficiency is an autosomal recessive bleeding disorder that affects approximately 1 in 500000 people. FVII deficiency can be clinically mild, moderate or severe, with mild to moderate deficiency characterized by increased bleeding after surgery and trauma. Patients with severe FVII deficiency (less than 1% FVII activity) experience similar symptoms to hemophilia. For example, FVII-deficient subjects are prone to joint bleeds joint bleeds, spontaneous nose-bleeds, gastrointestinal bleeding, urinary tract bleeding. Intracerebral hemorrhaging and muscle bleeds have also been reported, while women can experience severe menorrhagia (heavy menstrual bleeding). Treatment can be effected by replacement therapy. A recombinant FVIIa product (NovoSeven®, Novo Nordisk) has been approved and licensed for the treatment of bleeding episodes in patients with congenital FVII deficiency and for the prevention of bleeding in surgical interventions or invasive procedures in patients with congenital FVII deficiency. Hence, the modified FVII polypeptides herein can be similarly used. The modified FVII polypeptides provided herein can be used in the treatment of bleeding episodes and the prevention of bleeding in surgical interventions or invasive procedures in FVII-deficient patients. For example, a neonatal patient presenting with severe FVII deficiency with intracranial hemorrhaging can be administered modified FVII polypeptides by intravenous bolus to effect coagulation and maintain hemostasis. Generally the modified FVII polypeptides are administered as activated FVII (FVIIa) polypeptides.

c. Others

Other bleeding disorders can be treated with the FVII polypeptides provided herein to promote coagulation. Congenital deficiencies of factors V and X also present with increased blood clotting times and can potentially be treated with administration of therapeutic doses of FVII. For example, a patient with factor X deficiency can be administered rFVIIa to control bleeding associated with splenectomy (Boggio et al. (2001) Br J Haematol 112:1074-1075). Spontaneous and surgery associated bleeding episodes associated with von Willebrand disease (vWD) also can be treated using the modified FVII polypeptides provided herein. VWD is a bleeding disorder caused by a defect or deficiency of the blood clotting protein, von Willebrand Factor (vWF), and is estimated to occur in 1% to 2% of the population. Subjects with vWD bruise easily, have recurrent nosebleeds, bleed after tooth extraction, tonsillectomy or other surgery, and women patients can have increased menstrual bleeding. Modified FVII polypeptides can be used to ameliorate spontaneous and surgery-associated bleeding in vWD patients (von Depka et al. (2006) Blood Coagul Fibrin 17:311-316). Other platelet-related bleeding disorders, such as for example, Glanzmann's thrombasthenia and Hermansky-Pudlak syndrome also are associated with reduced endogenous clotting activity. Excess spontaneous or surgery-associated bleeding in patients with platelet related bleeding disorders also can be controlled by therapeutic doses of the modified FVII polypeptides. For example, a patient with Glanzmann's thrombasthenia undergoing surgery can be treated before, during and/or after surgery with the modified FVII polypeptides to prevent major blood loss (van Buuren et al. (2002) Dig Dis Sci 47:2134-2136). Generally, the modified FVII polypeptides are administered as activated FVII (FVIIa) polypeptides.

2. Acquired Bleeding Disorders a. Chemotherapy-Acquired Thrombocytopenia

Bleeding disorders also can be acquired, rather than congenital. For example, chemotherapy treatment, such as for leukemia and other cancers, can result in thrombocytopenia. This is likely due to a loss of platelet production in the bone marrow of patients receiving chemotherapy, and typically occurs 6-10 days after medication. Treatment of the acquired thrombocytopenia is usually by platelet, red blood cell or plasma transfusion, which serves to prevent any abnormal spontaneous bleeding that can result from platelet deficiency. Bleeding in patients with chemotherapy-induced thrombocytopenia, or any other acquired or congenital thrombocytopenia, also can be controlled by administration of therapeutic amounts of the modified FVII polypeptides provided herein. For example, a thrombocytopenic patient with uncontrolled bleeding, such as in the gastrointestinal tract, can be administered an intravenous bolus injection of a therapeutic amount of FVII polypeptide to stop hemorrhaging (Gerotziafas et al. (2002) Am J Hematol 69:219-222). Generally, the modified FVII polypeptides are administered as activated FVII (FVIIa) polypeptides.

b. Other Coagulopathies

Other acquired coagulopathies can be treated using the modified FVII polypeptides presented herein. Coagulopathy can result from conditions including, but not limited to, fulminant hepatic failure (FHF; such as caused by hepatoxic drugs, toxins, metabolic diseases, infectious diseases and ischemia), other liver disease, including cirrhosis and disease associated with Wilson's disease, vitamin K deficiency (such as caused by antibiotic treatment or diet), hemolytic uremic syndrome, thrombotic thrombocytopenia (TTC) and disseminated intravascular coagulopathy (DIC). Conventional treatment is generally by transfusion with plasma, red blood cells (RBC), or platelets, but can be unsuccessful. In one embodiment, the modified FVII polypeptides can be administered to a patient with FHF undergoing invasive procedures to prevent bleeding. Conventional treatment with fresh frozen plasma (FFP) often is unsuccessful and can require large quantities of plasma, producing volume overload and anasarca (a generalized infiltration of edema fluid into subcutaneous connective tissue). Treatment with therapeutic amounts of modified FVII polypeptides by intravenous bolus during, before and/or after invasive surgery, such as for example, liver biopsy or liver transplantation, can prevent bleeding and establish hemostasis in FHF patients. The patient can be monitored by PT of the blood to determine the efficacy of treatment (Shami et al. (2003) Liver Transpl 9:138-143). In another embodiment, FVII can be administered to a patient with severe bleeding associated with coagulopathy, such as for example, severe post-cesarean intra-abdominal bleeding associated with liver dysfunction and DIC, that did not respond to conventional transfusions infusions (Moscardo et al. (2001) Br J Haematol 113:174-176). Further, the modified FVII polypeptides can be used to treat coagulopathy in neonatal and pediatric patients. In a particular embodiment, the neonatal and pediatric patients do not respond to conventional treatment, such as RBC and platelet infusion. For example, neonates with severe pulmonary hemorrhaging associated with increased PTs who do not respond to RBC and platelet transfusion can be administered modified FVII polypeptides to decrease PT and establish hemostasis (Olomu et al. (2002) J Perinatol 22:672-674). The modified FVII polypeptides provided herein exhibit enhanced coagulation activity compared with unmodified FVII polypeptides, and can therefore be administered, for example, at lower doses, less frequently, and with fewer adverse reactions. Generally the modified FVII polypeptides are administered as activated FVII (FVIIa) polypeptides.

c. Transplant-Acquired Bleeding

Severe bleeding following bone marrow transplant (BMT) and stem cell transplant (SCT) is a relatively common and life-threatening complication associated with these procedures, due to the reduction of platelets. For example, diffuse alveolar hemorrhage (DAH) is a pulmonary complication of BMT with an estimated incidence of 1-21% in the transplant population, and a mortality rate of 60-100%. Conventional treatment of such bleeding episodes includes corticosteroid treatment and transfusion with plasma, platelets and/or RBC, although these are largely unsuccessful with an overall mortality rate of approximately 50% (Hicks et al. (2002) Bone Marrow Transpl 30:975-978). Administration of FVII by intravenous bolus, with or without concurrent treatment with corticosterioids and/or platelet infusion, can be performed to treat DAH and establish hemostasis (Hicks et al. (2002) Bone Marrow Transpl 30:975-978). The modified FVII polypeptides provided herein exhibit enhanced coagulation activity compared with unmodified FVII polypeptides, and might therefore be administered, for example, at lower doses, less frequently, over a shorter treatment duration, and with fewer adverse reactions for the same biological activity and efficacy. Generally the modified FVII polypeptides are administered as activated FVII (FVIIa) polypeptides.

d. Anticoagulant Therapy-Induced Bleeding

Patients undergoing anticoagulant therapies for the treatment of conditions, such as thromboembolism, can exhibit bleeding episodes upon acute administration of anticoagulants, such as warfarin, heparin and fondaparinux, or develop hemorrhagic disorders as a result long term usage of such therapies. Treatments for bleeding episodes typically include administration of procoagulants, such as vitamin K, plasma, exogenous FIX, and protamines to neutralize heparin. Administration of exogenous FVII also can be performed to neutralize the effect of the anti-coagulants, increase PT, aPTT, and/or other markers of coagulation and establish hemostasis (Deveras et al. (2002) Ann Inten Med 137:884-888). The modified FVII polypeptides provided herein can be used in treatments to control bleeding episodes in patients with acquired bleeding disorders due to anticoagulant treatments. Generally the modified FVII polypeptides are administered as activated FVII (FVIIa) polypeptides.

e. Acquired Hemophilia

Factor VIII inhibitors can develop spontaneously in otherwise healthy individuals, resulting in a condition known as "acquired hemophilia". Acquired hemophilia is a rare condition, with a yearly incidence of 0.2-1.0 per million population. The autoantibodies are mainly IgG4 antibodies, which, when bound to FVIII, inhibit FVIII activity by interfering with thrombin cleavage, von Willebrand factor interaction and/or phospholipid binding. This results in life-threatening hemorrhage in approximately 87% of affected patients. Common sites of bleeding are skin, mucosa, muscles and retroperitoneum, in contrast to patients with hereditary hemophilia who bleed predominantly in joints and muscles. Acquired hemophilia can be treated with an activated prothrombin complex concentrate or recombinant activated factor VII (NovoSeven®, Novo Nordisk) to control bleeding episodes. The modified FVII polypeptides provided herein exhibit enhanced coagulation activity compared with unmodified FVII polypeptides, and can therefore be administered, for example, at lower doses, less frequently, over a shorter treatment duration, and with fewer adverse reactions for the same biological activity and efficacy. Generally the modified FVII polypeptides are administered as activated FVII (FVIIa) polypeptides.

3. Trauma and Surgical Bleeding

FVII polypeptides can be used as therapy to treat bleeding associated with perioperative and traumatic blood loss in subjects with normal coagulation systems. For example, FVII polypeptides can be administered to a patient to promote coagulation and reduce blood loss associated with surgery and, further, reduce the requirement for blood transfusion. In one embodiment, FVII polypeptides can be administered to subjects undergoing retropubic prostatectomy. Retropubic prostatectomy is often associated with major blood loss and a subsequent need for transfusion. Subjects undergoing such or similar surgery can be given an intravenous bolus of a therapeutic amount of FVII in the early operative phase to reduce perioperative blood loss by enhancing coagulation at the site of surgery. Reduction in blood loss results in elimination of the need for blood transfusion in these patients (Friederich et al. (2003) Lancet 361:201-205). FVII polypeptides can be administered to patients with normal coagulation undergoing other types of surgery to effect rapid hemostasis and prevent blood loss. Non-limiting examples of surgical procedures in which FVII, typically administered in the activated form (i.e. FVIIa), can be used a therapy to reduce perioperative bleeding include, but are not limited to, cardiac valve surgery (Al Douri et al. (2000) Blood Coag Fibrinol 11:S121-S127), aortic valve replacement (Kastrup et al. (2002) Ann Thorac Surg 74:910-912), resection of recurrent hemangiopericytoma (Gerlach et al. (2002) J Neurosurg 96:946-948), cancer surgery (Sajdak et al. (2002) Eur J Gynaecol Oncol 23:325-326), and surgery on duodenal ulcers (Vlot et al. (2000) Am J Med 108:421-423). Treatment with FVII can promote hemostasis at the site of surgery and reduce or prevent blood loss, thereby reducing or abolishing the need for transfusion. The modified FVII polypeptides provided herein are designed to exhibit enhanced coagulation activity compared with unmodified FVII polypeptides, and might therefore be administered, for example, at lower doses, less frequently, and with fewer adverse reactions. Generally the modified FVII polypeptides are administered as activated FVII (FVIIa) polypeptides.

Factor VII polypeptides also can be used to promote coagulation and prevent blood loss in subjects with traumatic injury. Trauma is defined as an injury to living tissue by an extrinsic agent, and is the fourth leading cause of death in the United States. Trauma is classified as either blunt trauma (resulting in internal compression, organ damage and internal hemorrhage) or penetrative trauma (a consequence of an agent penetrating the body and destroying tissue, vessel and organs, resulting in external hemorrhaging). Trauma can be caused by several events including, but not limited to, vehicle accidents (causing blunt and/or penetrative trauma), gun shot wounds (causing penetrative trauma), stabbing wounds (causing penetrative trauma), machinery accidents (causing penetrative and/or blunt trauma), and falls from significant heights (causing penetrative and/or blunt trauma). Uncontrolled hemorrhage as a result of trauma is responsible for most of the associated mortality. Diffuse coagulopathy is a relatively common complication associated with trauma patients, occurring in as many as 25-36% of subjects. Coagulopathy can develop early after injury, resulting from a variety of factors such as dilution and consumption of coagulation factors and platelets, fibrinolysis, acidosis, and hypothermia. Conventional management involves replacement therapy by transfusion with fresh frozen plasma (FFP) platelets, RBC and/or cryoprecipitate, correcting acidosis, and treating hypothermia. These steps often are insufficient to stop the bleeding and prevent death. Treatment by administration of therapeutic amounts of FVII can promote coagulation and reduce blood loss in trauma patients. For example, a patient with a gun shot injury presenting with massive blood, in addition to surgical intervention, be administered FVII to control coagulopathic bleeding (Kenet et al. (1999) Lancet 354:1879). Coagulant therapy with FVII can effectively reduce blood loss and hemorrhage in patients with blunt and penetrating trauma (Rizoli et al. (2006) Crit. Care 10:R178). The modified FVII polypeptides provided herein are designed to exhibit enhanced coagulation activity compared with unmodified FVII polypeptides, and might therefore be administered, for example, at lower doses, less frequently, and with fewer adverse reactions. Generally the modified FVII polypeptides are administered as activated FVII (FVIIa) polypeptides.

I. Combination Therapies

Any of the modified FVII polypeptides described herein can be administered in combination with, prior to, intermittently with, or subsequent to, other therapeutic agents or procedures including, but not limited to, other biologics, small molecule compounds and surgery. For any disease or condition, including all those exemplified above, for which FVII (including FVIIa and rFVIIa) is indicated or has been used and for which other agents and treatments are available, FVII can be used in combination therewith. Hence, the modified FVII polypeptides provided herein similarly can be used. Depending on the disease or condition to be treated, exemplary combinations include, but are not limited to, combination with other plasma purified or recombinant coagulation factors, procoagulants, such as vitamin K, vitamin K derivative and protein C inhibitors, plasma, platelets, red blood cells and corticosteroids.

J. Articles of Manufacture and Kits

Pharmaceutical compounds of modified FVII polypeptides or nucleic acids encoding modified FVII polypeptides, or a derivative or a biologically active portion thereof can be packaged as articles of manufacture containing packaging material, a pharmaceutical composition which is effective for treating a hemostatic disease or disorder, and a label that indicates that modified FVII polypeptide or nucleic acid molecule is to be used for treating hemostatic disease or disorder.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,352, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any hemostatic disease or disorder.

Modified FVII polypeptides and nucleic acid molecules also can be provided as kits. Kits can include a pharmaceutical composition described herein and an item for administration. For example a modified FVII can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of FVII or a FVII regulated system of a subject.

The following examples are included for illustrative purposes only and are not intended to limit the scope of the invention.

K. EXAMPLES

Example 1

Cloning and Expression of FVII

A. Cloning of FVII

The nucleotides encoding the 466 amino acid human FVII isoform precursor polypeptide (P08709; set forth in SEQ ID NO:1) were cloned into the mammalian expression vector, pCMV Script (Stratagene; SEQ ID NO:99), which contains a cytomegalovirus (CMV) promoter. Briefly, the CBO-125 (SEQ ID NO:100) and CBO-126 (SEQ ID NO:101) oligonucleotides were used as forward and reverse primers, respectively, to amplify the FVII sequence by PCR using human FVII cDNA (Invitrogen) as the template. The CBO-125 primer contained a BamHI restriction site (in bold), a Kozak sequence (double underlined), followed by 18 nucleotides with homology to the 5' end of the FVII cDNA sequence (underlined), including the ATG start codon. The CBO-126 primer contained an EcoRI restriction site (in bold), a stop codon (double underlined) and 21 nucleotides with homology to the 3' end of the FVII cDNA sequence (underlined).

```
CBO-125 forward primer
5' gcatcatgacgtgacggatccgccaccatggtctcccaggccctc
3'

CBO-126 reverse primer
5' gatcgtacgatacgtgaattcctagggaaatggggctcgcaggag
3'
```

Standard PCR reaction and thermocycling conditions were used in conjunction with the KoD HiFi PCR kit (EMD Biosciences), as recommended by the manufacturer. The PCR product was digested with BamH I and EcoR I restriction enzymes and ligated into the BamH I and EcoR I restriction sites of pCMV Script vector using standard molecular techniques. The vector was then transformed into *Escherichia coli*. Selected colonies were grown and bacterial cells harvested for purification of the plasmid using routine molecular biology techniques.

B. Generation of FVII Variants

FVII variants were generated using the QuikChange II XL Site-Directed Mutagenesis kit (Stratagene) according to the manufacturers instructions, with specifically designed oligonucleotides that served as primers that incorporated a particular mutation into newly synthesized DNA. The QuikChange method involves linear amplification of template DNA by the PfuUltra high-fidelity DNA polymerase. Complementary primers that include the desired mutation were extended during cycling using purified, double-stranded supercoiled pCMV Script vector that contained the cloned FVII cDNA sequence as a template. Extension of the primers resulted in incorporation of the mutation of interest into the newly synthesized strands, and resulted in a mutated plasmid with staggered nicks. Following amplification, the nucleic acid was treated with Dpn I, which digests the dam-methylated parental strands of the *E. coli*-derived pCMV Script vector. This resulted in "selection" of the newly-synthesized mutated plasmids, which were not methylated. The vector DNA containing the desired mutation(s) were transformed into XL10-Gold ultracompetent *E. coli* cells, where bacterial ligase repaired the nicks and allowed normal replication to occur.

Table 13 below sets forth the FVII variants that were generated. In some instances, FVII variants were generated in which a binding sequence for platelet integrin $\alpha_{IIb}\beta_3$ was inserted in various regions of the FVII polypeptide. One of three different integrin $\alpha_{IIb}\beta_3$ binding sequences were inserted: SFGRGDIRNV (SEQ ID NO:110); CSFGRGDIRNVC (SEQ ID NO:111); or GGGSCSFGRGDIRNVC (SEQ ID NO:112). The integrin $\alpha_{IIb}\beta_3$ binding sequences were inserted at the C-terminus of the FVII polypeptide after amino acid residue P406 by mature FVII numbering, or inserted by deletion and replacement of FVII amino acid residues S103 to S111, H115 to S126 or T127 to P134 by mature FVII numbering. Other FVII variants in which a serum albumin binding sequence was inserted also were generated. These FVII variants contained one of seven different serum albumin binding sequences: QRLMEDICLPRWGCLWEDDF (SEQ ID NO:103), IEDICLPRWGCLWE (SEQ ID NO:104), DICLPRWGCLWED (SEQ ID NO:105), IEDICLPRWGCLW (SEQ ID NO:106), GGGSIEDICLPRWGCLW (SEQ ID NO:107), DICLPRWGCLWED (SEQ ID NO:108), or GGGSDICLPRWGCLWED (SEQ ID NO:109). The serum albumin binding sequences were inserted at the C-terminus of the FVII polypeptide after amino acid residue P406 by mature FVII numbering, or inserted by deletion and replacement of FVII amino acid residues S103 to S111, H115 to S126 or T128 to P134 by mature FVII numbering. The "Gla Swap FIX" FVII variants (i.e. a FVII polypeptide in which the endogenous Gla domain has been replaced with the Gla domain from FIX) contains amino acid residues Y1 to Y45 of SEQ ID NO:83 at the N-terminus. In some examples, the "Gla Swap FIX" variants contain one or more amino acid substitutions in the FIX Gla domain portion. Mutations that are in the FIX Gla domain portion are enclosed in curly brackets and are referenced using amino acid positions corresponding to the amino acid positions of a mature wild-type FIX polypeptide, or the wild-type FIX Gla domain set forth in SEQ ID NO:83. For example, {Gla Swap FIX/M19K} denotes that the modified FVII polypeptide contains a heterologous FIX Gla domain in which the methionine at position 19 of the FIX Gla domain set forth in SEQ ID NO:83 is replaced with a lysine. In Table 13 below, the amino acid residues at which the platelet integrin $\alpha_{IIb}\beta_3$ or serum albumin binding sequence is inserted in the FVII polypeptide, and the amino acid sequence of the binding sequence, are both represented. For example, H115S126delinsQRLMEDICLPRWGCLWEDDF indicates that amino acid residues H115 thru S126 have been deleted and replaced with a serum albumin binding sequence with the amino acid sequence QRLMEDICLPRWGCLWEDDF (SEQ ID NO:103).

TABLE 13

Factor VII Variants

| Variant (mature FVII numbering) | Variant (Chymotrypsin numbering) | FVII polypeptide SEQ ID NO |
|---|---|---|
| Wild-type | Wild-type | 3 |
| Q286N | Q143N | 113 |
| Q286E | Q143E | 114 |
| Q286D | Q143D | 115 |
| Q286S | Q143S | 116 |
| Q286T | Q143T | 117 |
| Q286R | Q143R | 118 |
| Q286K | Q143K | 119 |
| Q286A | Q143A | 120 |
| Q286V | Q143V | 121 |
| Q286M | Q143M | 122 |
| Q286L | Q143L | 123 |
| Q286Y | Q143Y | 124 |
| Gla Swap FIX/Q286R | Gla Swap FIX/Q143R | 131 |
| H257A/Q286R | H117A/Q143R | 132 |
| S222A/Q286R | S82A/Q143R | 133 |
| S222A/H257A/Q286R | S82A/H117A/Q143R | 134 |
| Gla Swap FIX/S222A/Q286R | Gla Swap FIX/S82A/Q143R | 135 |
| Gla Swap FIX/H257A/Q286R | Gla Swap FIX/H117A/Q143R | 136 |
| Gla Swap FIX/S222A/H257A/Q286R | Gla Swap FIX/S82A/H117A/Q143R | 137 |
| Q286R/M298Q | Q143R/M156Q | 138 |
| Q286R/M298Q/K341Q | K192Q/Q143R/M156Q | 139 |
| K199E/Q286R/M298Q | K60cE/Q143R/M156Q | 140 |
| Gla Swap FIX/Q286R/M298Q | Gla Swap FIX/Q143R/M156Q | 141 |
| Q286R/Q366V | Q143R/Q217V | 142 |
| Q286R/A292N/A294S/Q366V | Q143R/A150N/A152S/Q217V | 143 |
| A175S/Q286R/Q366V | A39S/Q143R/Q217V | 144 |
| S222A/Q286R/Q366V | S82A/Q143R/Q217V | 145 |
| H257S/Q286R | H117S/Q143R | 146 |
| H257S/Q286R/Q366V | H117S/Q143R/Q217V | 147 |
| S222A/H257A/Q286R/Q366V | S82A/H117A/Q143R/Q217V | 148 |

TABLE 13-continued

Factor VII Variants

| Variant (mature FVII numbering) | Variant (Chymotrypsin numbering) | FVII polypeptide SEQ ID NO |
|---|---|---|
| Q286R/H373A | Q143R/H224A | 149 |
| S222A/H257A/Q286R/M298Q | S82A/H117A/Q143R/M156Q | 150 |
| V158D/E296V/M298Q | V158D/E296V/M298Q | 158 |
| Q286R/K341D | Q143R/K192D | 151 |
| Q286R/Q366D | Q143R/Q217D | 152 |
| Q286R/Q366N | Q143R/Q217N | 153 |
| Q286R/M298Q/Q366D | Q143R/M156Q/Q217D | 154 |
| Q286R/M298Q/Q366N | Q143R/M156Q/Q217N | 155 |
| Q286R/H373F | Q143R/H224F | 156 |
| Q286R/M298Q/H373F | Q143R/M156Q/H224F | 157 |
| T239S | T99S | 159 |
| T239N | T99N | 160 |
| T239Q | T99Q | 161 |
| T239V | T99V | 162 |
| T239L | T99L | 163 |
| T239H | T99H | 164 |
| T239I | T99I | 165 |
| P321K | P170iK | 166 |
| P321E | P170iE | 167 |
| P321Y | P170iY | 168 |
| P321S | P170iS | 169 |
| Q366D | Q217D | 170 |
| Q366E | Q217E | 171 |
| Q366N | Q217N | 172 |
| Q366T | Q217T | 173 |
| Q366S | Q217S | 174 |
| Q366V | Q217V | 175 |
| Q366I | Q217I | 176 |
| Q366L | Q217L | 177 |
| Q366M | Q217M | 178 |
| H373D | H224D | 179 |
| H373E | H224E | 180 |
| H373S | H224S | 181 |
| H373F | H224F | 182 |
| H373A | H224A | 183 |
| Q366D/H373E | Q217D/H224E | 184 |
| Q366V/H373V | Q217V/H224V | 185 |
| Q366V/H373L | Q217V/H224L | 186 |
| Q366V/H373I | Q217V/H224I | 187 |
| K161S | K24S | 188 |
| K161A | K24A | 189 |
| K161V | K24V | 190 |
| H216S | H76S | 191 |
| H216A | H76A | 192 |
| H216K | H76K | 193 |
| H216R | H76R | 194 |
| S222A | S82A | 195 |
| S222K | S82K | 196 |
| S222V | S82V | 197 |
| S222D | S82D | 200 |
| S222N | S82N | 198 |
| S222E | S82E | 199 |
| H257A | H117A | 201 |
| H257S | H117S | 202 |
| S222K/H257A | S82K/H117A | 203 |
| H216A/H257A | H76A/H117A | 204 |
| H216A/S222A | H76A/S82A | 205 |
| S52A | S[52]A | 206 |
| S60A | S[60]A | 207 |
| E394N/P395A/R396S | E245N/P246A/R247S | 208 |
| R202S | R62S | 209 |
| A292N/A294S | A150N/A152S | 210 |
| G318N | G170fN | 211 |
| A175S | A39S | 212 |
| K109N | K-26N | 213 |
| A122N/G124S | A[122]N/G[124]S | 214 |
| A51N | A-84N | 215 |
| T130N/E132S | T[130]N/E[132]S | 216 |
| S50A/S62A | S[50]A/S[62]A | 217 |
| A122N/G124S/E394N/P395A/R396S | A[122]N/G[124]S/E245N/P246A/R247S | 218 |
| A122N/G124S/E394N/P395A/R396S/G318N | A[122]N/G[124]S/E245N/P246A/R247S/G170fN | 219 |
| S52N/P54S | S[52]N/P[54]S | 220 |

TABLE 13-continued

Factor VII Variants

| Variant (mature FVII numbering) | Variant (Chymotrypsin numbering) | FVII polypeptide SEQ ID NO |
|---|---|---|
| S119N/L121S | S[119]N/L[121]S | 221 |
| T128N/P129A | T[128]N/P[129]A | 222 |
| Q66N/Y68S | Q[66]N/Y[68]S | 223 |
| S52N/P54S/A122N/G124S/E394N/P395A/R396S | S[52]N/P[54]S/A[122]N/G[124]S/E245N/P246A/R247S | 224 |
| K109N/A292N/A294S | [K109N]/A150N/A152S | 225 |
| K109N/A175S | [K109N]/A39S | 226 |
| V158T/L287T/M298K | V21T/L144T/M156K | 256 |
| V158D/L287T/M298K | V21D/L144T/M156K | 257 |
| S103S111delinsQRLMEDICLPRWGCLWEDDF | S[103]S[111]delinsQRLMEDICLPRWGCLWEDDF | 227 |
| H115S126delinsQRLMEDICLPRWGCLWEDDF | H[115]S[126]delinsQRLMEDICLPRWGCLWEDDF | 228 |
| T128P134delinsQRLMEDICLPRWGCLWEDDF | T[128]P[134]delinsQRLMEDICLPRWGCLWEDDF | 229 |
| S103S111delinsIEDICLPRWGCLWE | S[103]S[111]delinsIEDICLPRWGCLWE | 230 |
| H115S126delinsIEDICLPRWGCLWE | H[115]S[126]delinsIEDICLPRWGCLWE | 231 |
| T128P134delinsIEDICLPRWGCLWE | T[128]P[134]delinsIEDICLPRWGCLWE | 232 |
| S103S111delinsDICLPRWGCLWED | S[103]S[111]delinsDICLPRWGCLWED | 233 |
| H115S126delinsDICLPRWGCLWED | H[115]S[126]delinsDICLPRWGCLWED | 234 |
| T128P134delinsDICLPRWGCLWED | T[128]P[134]delinsDICLPRWGCLWED | 235 |
| P406insIEDICLPRWGCLW | P257insIEDICLPRWGCLW | 236 |
| P406insGGGSIEDICLPRWGCLW | P257insGGGSIEDICLPRWGCLW | 237 |
| P406insDICLPRWGCLWED | P257insDICLPRWGCLWED | 238 |
| P406insGGGSDICLPRWGCLWED | P257insGGGSDICLPRWGCLWED | 239 |
| S103S111delinsSFGRGDIRNV | S[103]S[111]delinsSFGRGDIRNV | 240 |
| H115S126delinsSFGRGDIRNV | H[115]S[126]delinsSFGRGDIRNV | 241 |
| T127P134delinsSFGRGDIRNV | T[128]P[134]delinsSFGRGDIRNV | 242 |
| P406insCSFGRGDIRNVC | P257insCSFGRGDIRNVC | 243 |
| P406insGGGSCSFGRGDIRNVC | P257insGGGSCSFGRGDIRNVC | 244 |
| Gla Swap FIX/S222A | Gla Swap FIX/S82A | 245 |
| Gla Swap FIX/H257A | Gla Swap FIX/H117A | 246 |
| Gla Swap FIX/S222A/H257A | Gla Swap FIX/S82A/H117A | 247 |
| S222A/M298Q | S82A/M156Q | 248 |
| H257A/M298Q | H117A/M156Q | 249 |
| S222A/H257A/M298Q | S82A/H117A/M156Q | 250 |
| S222A/A292N/A294S/Q366V | S82A/A150N/A152S/Q217V | 251 |
| A175S/S222A/Q366V | A39S/S82A/Q217V | 252 |
| S222A/Q366V | S82A/Q217V | 253 |
| H257S/Q366V | H117S/Q217V | 254 |
| S222A/H373A | S82A/H224A | 255 |
| S103S111delinsIEDICLPRWGCLWE/G237V | S[103]S[111]delinsIEDICLPRWGCLWE/G97V | 258 |
| S103S111delinsDICLPRWGCLWED/G237V | S[103]S[111]delinsDICLPRWGCLWED/G97V | 259 |
| H115S126delinsQRLMEDICLPRWGCLWEDDF/G237V | H[115]S[126]delinsQRLMEDICLPRWGCLWEDDF/G97V | 260 |
| H115S126delinsIEDICLPRWGCLWE/G237V | H[115]S[126]delinsIEDICLPRWGCLWE/G97V | 261 |
| H115S126delinsDICLPRWGCLWED/G237V | H[115]S[126]delinsDICLPRWGCLWED/G97V | 262 |
| T128P134delinsQRLMEDICLPRWGCLWEDDF/G237V | T[128]P[134]delinsQRLMEDICLPRWGCLWEDDF/G97V | 263 |
| T128P134delinsIEDICLPRWGCLWE/G237V | T[128]P[134]delinsIEDICLPRWGCLWE/G97V | 264 |
| S103S111delinsQRLMEDICLPRWGCLWEDDF/G237V | S[103]S[111]delinsQRLMEDICLPRWGCLWEDDF/G97V | 265 |
| T128P134delinsDICLPRWGCLWED/G237V | T[128]P[134]delinsDICLPRWGCLWED/G97V | 266 |
| S103S111delinsSFGRGDIRNV/G237V | S[103]S[111]delinsSFGRGDIRNV/G97V | 267 |
| H115S126delinsSFGRGDIRNV/G237V | H[115]S[126]delinsSFGRGDIRNV/G97V | 268 |
| T128P134delinsSFGRGDIRNV/G237V | T[128]P[134]delinsSFGRGDIRNV/G97V | 269 |
| M298Q/H373F | M156Q/H224F | 270 |
| S119N/L121S/A175S | S[119]N/L[121]S/A39S | 271 |
| T128N/P129A/A175S | T[128]N/P[129]A/A39S | 272 |

TABLE 13-continued

Factor VII Variants

| Variant (mature FVII numbering) | Variant (Chymotrypsin numbering) | FVII polypeptide SEQ ID NO |
|---|---|---|
| A122N/G124S/A175S | A[122]N/G[124]S/A39S | 273 |
| {GlaSwapFIX/E40L}/Q286R/M298Q | {GlaSwapFIX/E[40]L}/Q143R/M156Q | 274 |
| {GlaSwapFIX/K43I}/Q286R/M298Q | {GlaSwapFIX/K[43]I}/Q143R/M156Q | 275 |
| {GlaSwapFIX/Q44S}/Q286R/M298Q | {GlaSwapFIX/Q[44]S}/Q143R/M156Q | 276 |
| {GlaSwapFIX/M19K}/Q286R/M298Q | {GlaSwapFIX/M[19]K}/Q143R/M156Q | 277 |
| {GlaSwapFIX/M19K/E40L/K43I/Q44S}/Q286R/M298Q | {GlaSwapFIX/M[19]K/E[40]L/K[43]I/Q[44]S}/Q143R/M156Q | 278 |
| T128N/P129A/Q286R | T[128]N/P[129]A/Q143R | 279 |
| T128N/P129A/Q286R/M298Q | T[128]N/P[129]A/Q143R/M156Q | 280 |
| T128N/P129A/Q286R/H373F | T[128]N/P[129]A/Q143R/H224F | 281 |
| V158D/Q286R/E296V/M298Q | V21D/Q143R/E154V/M156Q | 282 |
| T128N/P129A/V158D/E296V/M298Q | T[128]N/P[129]A/V21D/E154V/M156Q | 283 |
| T128N/P129A/S222A | T[128]N/P[129]A/S82A | 284 |
| GlaSwapFIX/T128N/P129A/S222A/Q286R | GlaSwapFIX/T[128]N/P[129]A/S82A/Q143R | 285 |
| GlaSwapFIX/T128N/P129A/Q286R/M298Q | GlaSwapFIX/T[128]N/P[129]A/Q143R/M156Q | 286 |
| T128N/P129A/S222A/H257A/Q286R/M298Q | T[128]N/P[129]A/S82A/H117A/Q143R/M156Q | 287 |
| T128N/P129A/Q286R/M298Q/H373F | T[128]N/P[129]A/Q143R/M156Q/H224F | 288 |
| S52A/S60A/V158D/E296V/M298Q | S[52]A/S[60]A/V21D/E154V/M156Q | 289 |
| S52A/S60A/Q286R | S[52]A/S[60]A/Q143R | 290 |
| S52A/S60A/S222A | S[52]A/S[60]A/S82A | 291 |
| GlaSwapFIX/S52A/S60A/S222A/Q286R | GlaSwapFIX/S[52]A/S[60]A/S82A/Q143R | 292 |
| S52A/S60A/Q286R/M298Q | S[52]A/S[60]A/Q143R/M156Q | 293 |
| S52A/S60A/S222A/H257A/Q286R/M298Q | S[52]A/S[60]A/S82A/H117A/Q143R/M156Q | 298 |
| S52A/S60A/Q286R/H373F | S[52]A/S[60]A/Q143R/H224F | 296 |
| S52A/S60A/Q286R/M298Q/H373F | S[52]A/S[60]A/Q143R/M156Q/H224F | 297 |
| V158D/T239V/E296V/M298Q | V21D/T99V/E154V/M156Q | 298 |
| T239V/Q286R | T99V/Q143R | 299 |
| S222A/T239V | S82A/T99V | 300 |
| GlaSwapFIX/S222A/T239V/Q286R | GlaSwapFIX/S82A/T99V/Q143R | 301 |
| T239V/Q286R/M298Q | T99V/Q143R/M156Q | 302 |
| S222A/T239V/H257A/Q286R/M298Q | S82A/T99V/H117A/Q143R/M156Q | 303 |
| GlaSwapFIX/T239V/Q286R/M298Q | GlaSwapFIX/T99V/Q143R/M156Q | 304 |
| T239V/Q286R/H373F | T99V/Q143R/H224F | 305 |
| T239V/Q286R/M298Q/H373F | T99V/Q143R/M156Q/H224F | 306 |
| V158D/T239I/E296V/M298Q | V21D/T99I/E154V/M156Q | 307 |
| T239I/Q286R | T99I/Q143R | 308 |
| S222A/T239I | S82A/T99I | 309 |
| GlaSwapFIX/S222A/T239I/Q286R | GlaSwapFIX/S82A/T99I/Q143R | 310 |
| T239I/Q286R/M298Q | T99I/Q143R/M156Q | 311 |
| S222A/T239I/H257A/Q286R/M298Q | S82A/T99I/H117A/Q143R/M156Q | 312 |
| GlaSwapFIX/T239I/Q286R/M298Q | GlaSwapFIX/T99I/Q143R/M156Q | 313 |
| T239I/Q286R/H373F | T99I/Q143R/H224F | 314 |
| T239I/Q286R/M298Q/H373F | T99I/Q143R/M156Q/H224F | 315 |
| GlaSwapFIX/S222A/Q286R/H373F | GlaSwapFIX/S82A/Q143R/H224F | 316 |
| GlaSwapFIX/S222A/Q286R/M298Q | GlaSwapFIX/S82A/Q143R/M156Q | 317 |
| GlaSwapFIX/S222A/Q286R/M298Q/H373F | GlaSwapFIX/S82A/Q143R/M156Q/H224F | 318 |
| V158D/E296V/M298Q/H373F | V21D/E154V/M156Q/H224F | 319 |
| V158D/Q286R/E296V/M298Q/H373F | V21D/Q143R/E154V/M156Q/H224F | 320 |
| H257A/Q286R/M298Q | H117A/Q143R/M156Q | 321 |
| H257S/Q286R/M298Q | H117S/Q143R/M156Q | 322 |
| GlaSwapFIX/S222A/H257S/Q286R | GlaSwapFIX/S82A/H117S/Q143R | 323 |
| S222A/H257S/Q286R/M298Q | S82A/H117S/Q143R/M156Q | 324 |
| H257S/Q286R/M298Q/H373F | H117S/Q143R/M156Q/H224F | 325 |
| S222A/Q286R/M298Q/H373F | S82A/Q143R/M156Q/H224F | 326 |
| GlaSwapFIX/Q366V | GlaSwapFIX/Q217V | 327 |
| S222A/Q286R/M298Q | S82A/Q143R/M156Q | 328 |
| T128N/P129A/A175S/Q366V | T[128]N/P[129]A/A39S/Q217V | 329 |
| A122N/G124S/A175S/Q366V | A[122]N/G[124]S/A39S/Q217V | 330 |
| T128N/P129A/A175S/S222A | T[128]N/P[129]A/A39S/S82A | 331 |
| A122N/G124S/A175S/S222A | A[122]N/G[124]S/A39S/S82A | 332 |
| T128N/P129A/A175S/Q286R | T[128]N/P[129]A/A39S/Q143R | 333 |
| A122N/G124S/A175S/Q286R | A[122]N/G[124]S/A39S/Q143R | 334 |
| GlaSwapFIX/T128N/P129A/A175S/S222A/Q286R | GlaSwapFIX/T[128]N/P[129]A/A39S/S82A/Q143R | 335 |
| GlaSwapFIX/A122N/G124S/A175S/S222A/Q286R | GlaSwapFIX/A[122]N/G[124]S/A39S/S82A/Q143R | 336 |
| T128N/P129A/A175S/Q286R/M298Q | T[128]N/P[129]A/A39S/Q143R/M156Q | 337 |

TABLE 13-continued

Factor VII Variants

| Variant (mature FVII numbering) | Variant (Chymotrypsin numbering) | FVII polypeptide SEQ ID NO |
|---|---|---|
| A122N/G124S/A175S/Q286R/M298Q | A[122]N/G[124]S/A39S/Q143R/M156Q | 338 |
| T128N/P129A/A175S/S222A/H257A/Q286R/M298Q | T[128]N/P[129]A/A39S/S82A/H117A/Q143R/M156Q | 339 |
| A122N/G124S/A175S/S222A/H257A/Q286R/M298Q | A[122]N/G[124]S/A39S/S82A/H117A/Q143R/M156Q | 340 |
| T128N/P129A/A175S/Q286R/M298Q/H373F | T[128]N/P[129]A/A39S/Q143R/M156Q/H224F | 341 |
| A122N/G124S/A175S/Q286R/M298Q/H373F | A[122]N/G[124]S/A39S/Q143R/M156Q/H224F | 342 |
| T128N/P129A/M298Q | T[128]N/P[129]A/M156Q | 354 |
| {Gla Swap FIX/K43I}/T128N/P129A/Q286R/M298Q | {Gla Swap FIX/K[43]I}/T[128]N/P[129]A/Q143R/M156Q | 355 |
| T128N/P129A/Q286R/M298Q/Q366N | T[128]N/P[129]A/Q143R/M156Q/Q217N | 356 |
| {Gla Swap FIX/K43I}/Q286R/M298Q/Q366N | {Gla Swap FIX/K[43]I}/Q143R/M156QQ217N | 357 |
| {Gla Swap FIX/K43I}/T128N/P129A/Q286R/M298Q/Q366N | {Gla Swap FIX/K[43]I}/T[128]N/P[129]A/Q143R/M156Q Q217N | 358 |
| T128N/P129A/M298Q/H373F | T[128]N/P[129]A/M156Q/H224F | 359 |
| V158D/Q286R/E296V/M298Q | V21D/Q143R/E154V/M156Q | 360 |
| M298Q/Q366N/H373F | M156Q/Q217N/H224F | 361 |
| T239V/M298Q/H373F | T99V/M156Q/H224F | 362 |
| T239I/M298Q/H373F | T99I/M156Q/H224F | 363 |
| T128N/P129A/Q286R/M298Q/Q366N H373F | T[128]N/P[129]A/Q143R/M156Q/Q217N/H224F | 364 |
| T239V/Q286R/M298Q/Q366N | T99V/Q143R/M156Q/Q217N | 365 |
| T239I/Q286R/M298Q/Q366N | T99I/Q143R/M156Q/Q217N | 366 |
| T128N/P129A/T239V/Q286R/M298Q | T[128]N/P[129]A/T99V/Q143R/M156Q | 367 |
| T128N/P129A/S222A/T239V/H257A/Q286R/M298Q | T[128]N/P[129]A/S82A/T99V/H117A/Q143R/M156Q | 368 |
| T128N/P129A/T239V/Q286R/M298Q/H373F | T[128]N/P[129]A/T99V/Q143R/M156Q/H224F | 369 |
| T128N/P129A/T239I/Q286R/M298Q | T[128]N/P[129]A/T99I/Q143R/M156Q | 370 |
| T128N/P129A/T239I/Q286R/M298Q/H373F | T[128]N/P[129]A/T99I/Q143R/M156Q/H224F | 371 |

C. Expression of FVII Polypeptides

For initial expression analysis by ELISA and Western Blot, FVII polypeptides were expressed in BHK-21 cells. For biochemical assays, such as those described below, the FVII polypeptides were expressed in Freestyle™ 293-F cells (Invitrogen).

The wild-type Factor VII polypeptide (SEQ ID NO:3) and variant FVII polypeptides were initially expressed in the baby hamster kidney cell line BHK-21 (ATCC CRL 1632). BHK-21 cells were cultured in Eagle's minimal essential medium (EMEM, Invitrogen) with 10% fetal calf serum (FCS) in 100 mm culture dishes at 37° C. and 5% $CO_2$. After growth to approximately 90% confluence, the cells were transfected with 24 µg of FVII plasmid DNA using the Lipofectamine 2000 kit (Invitrogen) as instructed by the manufacturer. The media was replaced 6 hours after transfection with EMEM without serum containing 1 µg/ml vitamin K1 (Sigma) and the cells were incubated for a further 72 hours. Expression of FVII in the cell culture media was assayed by ELISA or Western Blot.

For subsequent analyses using biochemical assays, the wild-type Factor VII polypeptide (SEQ ID NO:3) and variant FVII polypeptides were expressed in Freestyle™ 293-F cells (Invitrogen). Cells were cultured in Freestyle™ 293 media (Invitrogen) at 37° C. and 8% $CO_2$ in Erlenmeyer flasks with vented caps. The cells were transfected using the manufacturer's suggested protocol. Briefly, after growth to $1 \times 10^6$ cells/ml, the cells were centrifuged and the media was exchanged. The cells were then transfected with 240 µg of FVII plasmid DNA for every 240 ml of cells using 293fectin (Invitrogen). In addition, 50 µl of a 1 mg/ml stock of Vitamin $K_1$ (Sigma) in ethanol was added for every 240 ml of cells. The cells were grown for 5 days then the culture supernatant was harvested. Expression of FVII in the cell culture media was assayed by ELISA.

In some examples, wild-type and variant FVII polypeptides were expressed in CHO-Express (CHOX) cells (Excellgene). CHO Express (CHOX) cell were maintained in DM202 Complete medium (SAFC BioSciences) and used to inoculate production seed cultures. Seed cultures were grown to $5 \times 10^6$ viable cells/mL and approximately 60 mL was used to inoculate approximately 0.6 L DM202 Complete medium (inoculation density is $0.4 \times 10^6$ vc/mL) to generate a production culture. This production culture was grown for 4 days to reach $8-12 \times 10^6$ vc/mL on the day of transfection. A transfection complex was formed using Factor VII plasmid DNA (6 mg) and 23.1 mg of Polyethylenimine (PEI). The transfection complex was then diluted in 0.5 L of serum-free Opti-MEM transfection medium (Invitrogen), which was added to the 0.6 L production culture. After 5 hours of transfection the culture was further diluted with ~1 L ProCHO5 medium (Lonza) supplemented with 8 mM L-glutamine and 4 mg/L Vitamin K1. The 2.2 L shake flask culture was allowed to express for 5-7 days before harvesting the crude Factor VII. Culture supernatants were then harvested by filtration and FVII was purified.

Expression of one of the FVII variants (Q286R/M298Q) was performed in a stable cell line. This line was generated at Excellgene (Monthey, Valais, Switzerland) by transfection of CHOX cells. Briefly, cells were grown in the presence of methotrexate, then plated by limiting dilution at 1 cell per well in 96-well plates. Clones producing the highest levels of variant FVII were determined by ELISA. One clone (clone 52) was further subcloned by a second limiting dilution and plating in 96-well plates. The colonies were grown at 37° C. in DM204A media (SAFC BioSciences), supplemented with 8 mM L-glutamine, 1 mM cysteine, 1 mg/L vitamin K1. Twenty-four clones were found to have higher levels of Q286R/M298Q expression, by ELISA analysis, than the original clone 52. These 24 clones were further expanded in 6-well plates for 6 days of growth, followed by growth in 40 mL shake flasks for four days. Each growth step was done at 37° C. in DM204A media, supplemented as above. After the four days of growth, clones were frozen at $1 \times 10^7$ viable cells/mL. The levels of Q286R/M298Q produced by each clone were determined by ELISA. Clone 5F7 was the highest producer, typically generating 25-35 mg/L Q286R/M298Q.

1. ELISA

An immunoassay was used to quantify the amount of human FVII and FVIIa in a sample. Polyclonal antibodies to human FVII were used to capture and detect the protease in the solution. The immunoassay can be used to determine protein concentration of conditioned medium or a purified stock or to determine the concentration of FVII in another sample, for example, a human or mouse plasma sample. The baseline concentration of FVII in human blood is approximately 50 nM and the enzymatically active form, FVIIa, is approximately 1 nM.

To determine the amount of human FVII or FVIIa protein in samples a sandwich ELISA was performed. Ninety-six well flat bottom Maxisorp immuno plates (Nunc) were coated with 100 μl/well of 5 ng/μl avidin (NeutrAvidin, Pierce Biotech.). The plates were covered and incubated with shaking for 1 hour at room temperature (RT) followed by washing four times in PBS with 0.01% Tween-20 (PBST). The plates were blocked for a minimum of 1 hour at RT with shaking by incubation with 1% bovine serum albumin (BSA) (w/v) in PBS added to each well at 200 μl/well. The blocked plates were then stored at 4° C. until use (up to 2 weeks).

Before use, the plates were washed four times in PBST to remove the BSA, and 100 μl/well of a 1 ng/μl solution of biotinylated anti-Factor VII antibody (R&D Systems) was added to each well and the plate was incubated at room temperature for 45 minutes with shaking to allow complexation with the coated avidin. Excess unbound antibody was removed by washing the plate with PBST (four times).

Serial two-fold dilutions of a FVII standard (American Diagnostica; diluted in PBST), ranging from 50 ng/μl to 0.8 ng/μl, were added to the plate at 100 μl/well. A well containing PBST without any FVII also was included as a buffer only control. To assay purified samples (before and after activation, see Example 3) of FVII or FVIIa, the sample was first diluted 1:25 in PBST, and then serial 2-fold dilutions were made so that 25-fold, 50-fold, 100-fold and 200-fold dilutions were tested. The diluted samples were added to the wells in duplicate at 100 μl/well. To assay plasma samples containing FVII or FVIIa, the plasma sample was diluted 1:100 and 1:400 in PBST and added to the wells in duplicate at 100 μl/well. A plasma sample without FVII or FVIIa also was included to determine background levels. The plates were then incubated for 30 minutes at RT with shaking to allow for any FVII or FVIIa in the sample to complex with the anti-FVII antibody.

After incubation with sample, the plates were washed 4 times with PBST. A secondary antibody, Equine anti-human FVII or Murine monoclonal anti-human FVII (American Diagnostica), was diluted 1:5000 in PBST and added to each well at a volume of 100 μl. The plates were incubated for 30 minutes at room temperature with shaking to allow the added antibody to bind to the FVII or FVII complexes on the plate. To remove excess secondary antibody, the plates were washed with PBST (4 times). To detect the bound secondary antibody, 100 μl of goat anti-equine HRP conjugate at a 1:5000 dilution in PBST, or 100 μl of goat anti-mouse HRP conjugate at a 1:20,000 dilution in PBST was added to each well. After incubation for 30 minutes at room temperature with shaking, the plates were washed four times with PBST and 100 μl/well of a solution containing a 1:1 mixture of TMB substrate and hydrogen peroxide solution (Pierce Biotech.) was added. The plates were shaken for approximately 1 minute at room temperature before addition of 100 μl/well of 2M $H_2SO_4$ to stop the reaction. The optical density at 450 nm was measured using a Molecular Device MS Plate reader and the background value for the plate (measured with PBST alone) was subtracted from the measured value from each well. A standard curve was generated by plotting the concentration of the FVII standards versus the absorbance. A standard curve range of about 0.2-50 ng/ml was typically generated under the above ELISA conditions. The concentration of each sample was then determined using the standard curve and multiplying by the dilution factor, and an average and standard deviation was reported.

2. Western Blot

Expression of FVII in cell culture media also was assayed by Western blot. Aliquots containing the undiluted sample, or two serial 2-fold dilutions in PBS, of the cell culture medium from FVII-transfected cells (BHK-21 or CHOX cells) were labeled Conc. 1 (undiluted), Conc. 2 (2-fold dilution) and Conc. 3 (4-fold dilution). The samples were loaded on an SDS page gel next to 10, 25, and 50 nanograms of control plasma purified rFVII (American Diagnostica). FVII protein produced by BHK-21 or CHOX cells was detected by Western blot using a primary polyclonal equine anti-FVII antibody (American Diagnostica; used at the manufacture's suggested concentration) and an HRP-conjugated anti-equine IgG secondary antibody (a 1:2000 dilution of 1 mg/ml solution from Zymed Laboratories). In some examples, the FVII was detected by Western blot using a primary rabbit anti-human Factor VIIa antibody (Hematologic Technologies) and an HRP-conjugated anti-rabbit IgG secondary antibody (Invitrogen). Comparison of expression levels was made with the control plasma purified rFVII. The results show that concentrations ranging from about 20 ng to more than 50 ng of FVII was present in the cell culture aliquots.

Example 2

Purification and Activation of FVII Polypeptides

FVII polypeptides were purified using a Q Sepharose Fast Flow, or CaptoQ column (GE Healthcare), to which FVII polypeptides with functional Gla domains will adsorb, followed by a calcium elution step. Typically, culture supernatant from the transfected was diluted 2-fold with a solution containing 20 mM Tris pH 8.0 and 0.01% Tween 20, and then 500 mM EDTA pH 8.0 was added to the diluted sample to a final concentration of 1.5 mM. The samples were filtered before being loaded onto the Q Sepharose Fast Flow or CaptoQ column, which had been pre-equilibrated first with Buffer B (20 mM Tris pH 8.0, 1 M NaCl, 0.01% Tween 20), then Buffer A (20 mM Tris pH 8.0, 0.15 M NaCl, 0.01% Tween 20). After being loaded, the column was washed with Buffer A until the absorbance of the flow-through at 280 nm reached a baseline. Buffer A was replaced with Buffer C (20 mM Tris pH 8.0, 0.15 M NaCl, 0.01% Tween 20, 5 mM $CaCl_2$) and a pump wash was performed to completely replace the buffer in the lines. Upon completion of the pump wash, Buffer C was applied to the column at 8 ml/min to elute the FVII polypeptides, which were collected in fractions. Following elution, the column was washed with Buffer B while still collecting fractions, until the pink pigment (from the culture media) was washed off the column. The column was then washed with Buffer A to requilibrate it for re-use.

The eluted fractions were further purified using a Mono Q or QHiTrap column (GE Healthcare), which was pre-equilibrated initially with Buffer B, and then with Buffer A. The fractions collected with buffer C above, which contained FVII, were pooled and diluted 2-fold with Buffer A, before EDTA, pH 8.0 was added to a final concentration of 40 mM. Small aliquots (e.g. 100 µl) were optionally taken at this point for analysis, such as by ELISA. The combined sample was loaded onto the Mono Q (or QHiTrap) column, then washed with Buffer A. To elute the bound FVII polypeptides, a gradient from 0% to 30% of Buffer B was run through the column and fractions were collected. The column was then washed with Buffer B followed by Buffer A to requilibrate for re-use.

In some examples, after the first Capto Q column, pooled fractions were buffer exchanged by diafiltration to Buffer D (20 mM MES, pH 6.0, 10 mM $CaCl_2$, 0.1 M NaCl, 0.01% Tween 20) then loaded onto an SP-HP column which had been pre-equilibrated with Buffer D. After washing with Buffer D, a gradient of 0.1 M NaCl to 1.0M NaCl was applied to the column and fractions were collected. Fractions containing FVII were then adjusted to pH 8.0 and diluted 2 fold in Buffer E (20 mM Tris, pH 8.0, 10 mM $CaCl_2$, 0.01% Tween 20) and applied to a Q H-HP column which had been pre-equilibrated with Buffer E. This column was then washed with Buffer E and the FVII was eluted by a gradient of 0-1 M NaCl in Buffer E.

Purified FVII polypeptides were activated to FVIIa using biotinylated Factor Xa from the Restriction Protease Factor Xa Cleavage and Removal Kit (Roche). Typically, 7 fractions from the Mono Q purification were pooled in a 15 ml conical tube and 388 µl of 500 mM $CaCl_2$, 38.9 µl of 10% BSA in distilled water, and 3.2 µg of biotinylated Factor Xa were added. After incubation for 14-16 hrs at 37° C., 250 µl of Immobilized Avidin (Pierce) was added and the sample was mixed at 4° C. for 30 minutes. The resulting solution was then filtered through an Econo-pak column (Bio-Rad), and the filtrate was mixed with another 250 µl of Immobilized Avidin for a further 30 minutes. The solution was filtered again and the filtrate was concentrated to approximately 300-500 µl using an Amicon Ultra-4 10 kDa centrifugal filter (Millipore). The FVIIa concentration was then analyzed by ELISA (as described in Example 1.C.1) and the level of Factor VII activation was monitored by Western blot. Western blotting was performed essentially as described in Example 1.C.2, but instead using rabbit anti-human Factor VIIa antibody (Haematologic Technologies, Inc.) at 1:2000 for 1 hr as the primary antibody, followed by HRP-Goat Anti-Rabbit IgG (H+L) (Invitrogen) at 1:5000 for 30 minutes.

Example 3

Determination of the Concentration of Catalytically Viable Protease in a Solution The concentration of catalytically viable FVIIa in a stock solution was determined by titrating a complex of Factor VIIa and soluble Tissue Factor (sTF) with an irreversible peptide inhibitor of FVIIa, Phe-Phe-Arg-Chloromethylketone (FFR-CMK). The inhibitor binds to FVIIa but not to FVII. Extended incubation at a high concentration of FVIIa (50 nM) ensures complete titration of the protease. The residual activity of the FVIIa/TF complex after incubation with FFR-CMK was measured to determine the concentration of catalytically viable FVIIa in the original stock solution.

A 96 well clear half area assay plate (Nunc) was pretreated by adding 150 µl/well of 1× plate buffer (100 mM Tris pH 8.4, 100 mM NaCl, 0.01% BSA, 0.01% Tween-20) to each well and incubating the plate at 37° C. for a minimum of 1 hour. The buffer was removed completely by blotting on a paper towel and centrifuging the plate upside down to remove any remaining buffer, and the plate was air-dried for 1 hour and stored covered at room temperature (RT).

To prepare the FVIIa/sTF/FFR-CMK reaction mixture, a stock of FVIIa (American Diagnostica; diluted to 5 µM in 50% glycerol (v/v) and stored cold in aliquots at −20° C.) or a FVIIa variant was first diluted to 500 nM in 1× direct assay buffer (100 mM Tris pH 8.4, 100 mM NaCl, 5 mM $CaCl_2$, 0.01% BSA). The FVIIa/sTF mixture was then made by mixing 90 µl distilled water with 36 µl 5× direct assay buffer, 18 µl 500 nM FVIIa, and 18 µl 5 µm sTF (recombinant human Coagulation Factor III/soluble tissue factor; R&D Systems; the stock solution used was 19.6 µM in 50% glycerol and was diluted to 5 µM in 1× direct assay buffer and stored up to two weeks at 4° C.). The components were then allowed to complex for 5 minutes at room temperature.

A stock solution of 10 mM FFR-CMK (BaChem) in DMSO (stored at −20° C.) was diluted in water to 3.5 µM. Using one row of a polypropylene opaque storage plate (Costar), serial two fold dilutions in water of the FFR-CMK were made across 11 wells of a 96-well opaque plate, with the last well of the row containing only water as a control. This is the 10×FFR-CMK inhibitor series solution. Into each well of a row of the pre-treated 96 well clear half area assay plate, 10.8 µl of the FVIIa/sTF mixture was added, followed by 1.2 µl of the 10×FFR-CMK inhibitor series. The solutions were mixed well and the plate was centrifuged at <3000 rpm for 5 minutes to remove drips in the wells. The plate was covered and incubated for 8 hours at 37° C.

To assay the residual activity of the FVIIa/TF complex, a mixture of the substrate Spectrozyme FVIIa (American Diagnostica, #217L; reconstituted stock of 50 µmole vial in 5 mL distilled water to 10 mM and stored at 4° C.) and 5× direct buffer (500 mM Tris pH 8.4, 500 mM NaCl, 25 mM $CaCl_2$ and 0.05% BSA) was first prepared by mixing 360 µl 5× direct assay buffer with 180 µl of a 10 mM solution of Spectrozyme FVIIa and 1080 µl of water. To each well of the assay plate, 108 µl of the prepared substrate solution was added. The wells were mixed and the plate was incubated at 37° C. The increase in absorbance at 405 nm was measured every 30 seconds for one hour at 37° C. on a Spectramax Gemini M5 plate reader from Molecular Devices.

Using SoftMax Pro software (Molecular Devices), the absorbance rates were measured and the fractional activity of proteases incubated with an inhibitor was determined by dividing the measured rate by the rate of the uninhibited protease. The fractional activity was graphed against the concentration of FFR-CMK, and points that were >90% or <10% of the uninhibited activity were discarded. A line was then drawn through the remaining points to determine the x-intercept, which represents the concentration of active protease in the solution. The values from multiple assays was measured and averaged and the standard deviation was determined.

Example 4

Determination of the Catalytic Activity of FVIIa for its Substrate, Factor X

The catalytic activity of the FVIIa variants for its substrate, Factor X (FX), was assessed indirectly in a fluorogenic assay by assaying for the activity of FXa, generated upon activation by FVIIa, on the synthetic substrate Spectrafluor FXa.
A. TF-Dependent Catalytic Activity of Wild-Type FVIIa for its Substrate, Factor X TF-dependent catalytic activity of wild-type FVIIa was assessed in a fluorogenic assay in which a lipidated form of purified tissue factor (TF) was included to provide for optimal activity of FVIIa. Enzyme activity of FXa for Spectrafluor FXa ($CH_3SO_2$-D-CHA-Gly-Arg-AMC.AcOH) was determined by measuring the increase in absorbance of the generated free fluorophore, AMC (7-amino-4-methylcoumarin), as a function of time.

Briefly, the wild-type FVIIa polypeptide was initially diluted to 0.5 µM in 1× assay buffer (100 mM Tris pH 8.4, 100 mM NaCl, 5 mM $CaCl_2$, and 0.01% BSA), then further diluted to 0.1 nM in assay buffer. Lipidated full-length TF (Innovin; Dade Behring) was reconstituted in 20 mL water to make a 3 nM solution and diluted to 0.2 nM in 1× assay buffer. Four hundred µl of 0.1 nM FVIIa was mixed with 400 µl 0.2 nM TF and incubated at room temperature for 5 minutes. The solution was diluted further by two, 2-fold dilutions into 1× assay buffer containing 0.2 nM TF to obtain a total of three FVIIa dilutions of 0.05 nM, 0.025 nM, or 0.0125 nM FVIIa each containing 0.2 nM TF (FVIIa/TF solutions).

The substrate, Factor X (FX; American Diagnostica; 80 µg) was reconstituted in 135.6 µl distilled water to give a 10 µM stock and stored in aliquots at −80° C. The aliquots were not frozen and thawed more than once. The FX stock was diluted to 800 nM in direct assay buffer, then serially diluted 2-fold to obtain FX solutions ranging from 800 nM to 50 nM.

Spectrofluor Xa (American Diagnostica; 10 µmoles) was reconstituted in distilled water to 5 mM and stored at 4° C. To a 96-well black half area assay plate (Costar), 5 µl Spectrofluor Xa (American Diagnostica) was added to each well. Then, 25 µl of the FX solution was added to each well. To the last row of wells of the plate, a negative control in which no FX was added also was included in the assay. In duplicate, the three concentrations of the TF/FVIIa solutions were added at 20 µl to wells of respective columns of the plate so that each TF/FVIIa dilution was assayed against each FX dilution, with one set of columns containing no added TF/FVIIa (i.e. FX alone). The plates were mixed by shaking. The fluorescence was measured over time with a spectrafluorometer set to read every 30 seconds for 1 hour at 37° C. (Ex: 380 nm, EM: 450 nm, Cut-off: 435 nm), and the time was reported in time squared units. Following the assay, a standard curve of AMC fluorescence in the same plate reader was generated to covert from fluorescence units to uM substrate released in the assay. A 1 mM AMC in DMSO (Invitrogen) was diluted to 0.02 mM in 1× assay buffer. Six, two-fold serial dilutions of the AMC were made ranging from 20 nM to 0.625 nM in 1× assay buffer. The fluorescence of the AMC was measured using the same assay conditions as described above and a graph of fluorescence versus concentration of AMC was plotted. The slope of the line was calculated, which served as the conversion factor for RFU to µM in subsequent calculations.

The kinetics constants for FVIIa activation of FX were calculated by performing linear regression analysis on the inverse of the substrate concentration versus the inverse of the velocity of substrate cleavage (in units of seconds 2), with $V_{max,\ FVIIa}$ calculated as the inverse of the γ-intercept, $K_{m,\ FVIIa}$ as the slope at the γ-intercept, and $V_{max}/K_{m,\ FVIIa}$ as the inverse of the slope. The $k_{cat}$ value was then derived using the equation;

$$k_{cat}/K_{m,\ FVIIa} = V_{max}/K_{m,\ FVIIa} \times 1/(0.5 \times k_2 \times [FVIIa\ in\ \mu M] \times (RFU/\mu M\ conversion\ factor))$$

where; $k_2 = ([S] \times k_{cat,\ FXa})/(K_{m,\ FXa} + [S])$, where $k_{cat,\ FXa}$ and $K_{m,\ FXa}$ are the constants for FXa cleavage of Spectrofluor Xa determined experimentally using FXa standards as $k_{cat,\ FXa} = 117\ sec^{-1}$, and $K_{m,\ FXa} = 164\ \mu M$.

Using the above assay conditions, the kinetic constant $k_2$ was determined to be 88.1 $sec^{-1}$.

The $K_m$ and $k_{cat}$ for each of the FVIIa variants was determined to assess the catalytic activity, $k_{cat}/K_m$ ($M^{-1}sec^{-1}$) of each for its substrate, FX (Table 14). The wild-type FVIIa protease was assessed and was found to exhibit an activity of $1.8 \times 10^7\ M^{-1}sec^{-1}$. Factor VIIa activation of Factor X, as measured by Krishnaswamy, et al. (J. Biol. Chem. (1998) 273:8 4378-86) is $2.9 \times 10^7\ M^{-1}sec^{-1}$.
B. Analysis of the Catalytic Activity of FVIIa Variants for the Substrate, Factor X The catalytic activity of the FVIIa variants for the substrate, Factor X (FX), was assessed indirectly in two types of chromogenic assays by assaying for the activity of FXa, generated upon activation by FVIIa, on the synthetic substrate Spectrafluor FXa. The two assays were performed either in the presence or the absence of lipidated tissue factor, to assess both TF-dependent and TF-independent activity. The FVII variants were expressed, purified and activated to FVIIa as described above in Examples 1 and 2. Although most FVII variants were expressed only in Freestyle™ 293-F cells, some also were expressed in BHK-21 cells.

Lipidated Tissue Factor-Dependent Indirect Assay

The catalytic activity of the FVIIa variants in the presence of tissue factor was assessed using the assay described in section A of Example 4, above, with minor modifications. One such modification was the use of a Factor X substrate protease that had been treated with ERG-CMK and FFR-CMK to reduce the background activity (Molecular Innovations). Two types of data analysis were performed using two separate assays; a linear range analysis assay and a hyperbolic range analysis assay. The linear range analysis assay used a range of Factor X concentrations between 0 and 150 nM to ensure accurate measurement of the kinetic constants in the linear range of the dose curve. In contrast, the hyperbolic range analysis assay used a range of Factor X concentrations between 0 and 1.44 µM to ensure accurate measurement of the kinetic constants with a saturating (hyperbolic) dose curve.

The lipidated tissue factor indirect assay with linear range data analysis was performed essentially as described in section A of Example 4, above, with the following modifications. The FVIIa variant/TF solutions were prepared as 0.1 nM FVIIa/0.4 nM TF solutions and incubated for 30 minutes before being diluted two-fold in 0.4 nM TF down to a solution containing 1.5625 µM FVIIa/0.4 nM TF. Twenty-five µL of the FVIIa/TF solution was mixed with 25 µL of a substrate solution that contained 1.0 mM Spectrofluor FXa (American Diagnostica) and one of 300 nM, 200 nM, 133.3 nM, 88.9 nM, 59.3, 39.5 nM, 36.3 nM or 0 nM of Factor X (Molecular Innovations). Thus, the final concentrations for the assay were 0.8 pM FVIIa, 0.2 nM TF, 0.5 mM Spectrofluor FXa and 150 nM, 100 nM, 66.7 nM, 44.4 nM, 29.6 nM, 19.8 nM, 13.2 nM or 0 nM of Factor X (Molecular Innovations) in 50 µL/well. The AMC standard curve, which served as the conversion factor for RFU to µM in subsequent calculations, was expanded to include a dose range that covered from 0 µM to 100 µM AMC.

The lipidated tissue factor indirect assay with hyperbolic range data analysis was performed essentially as described in section A of Example 4, above, with the following modifications. The FVIIa variant/TF solutions were prepared as 0.1 nM FVIIa/0.4 nM TF solutions and incubated for 30 minutes before being diluted two-fold in 0.4 nM TF down to 1.5625 pM (or 0.78 pM for proteases expected to have high activity) FVIIa/0.4 nM TF. Twenty-five µL of the FVIIa/TF solution was mixed with 25 µL of a substrate solution that contained 1.0 mM Spectrofluor FXa (American Diagnostica) and one of 1440 nM, 720 nM, 360 nM, 180 nM, 90 nM, 45 nM, 22.5 nM or 0 nM of Factor X (Molecular Innovations). Thus, the final concentrations for the assay were 0.8 (or 0.39) pM FVIIa, 0.2 nM TF, 0.5 mM Spectrofluor FXa and 7 nM, 720 nM, 360 nM, 180 nM, 90 nM, 45 nM, 22.5 nM, 11.25 nM or 0 nM of Factor X (Molecular Innovations) in 50 µL/well. The $k_{cat}$ and $K_m$ parameters are calculated using the Michaelis Menton hyperbolic equation of the form $(V_{max}/(1+(K_m/x)))$. The AMC standard curve, which served as the conversion factor for RFU to µM in subsequent calculations, was expanded to include a dose range that covered from 0 µM to 100 µM AMC.

To determine the kinetic rate constants for the FVIIa or FVIIa variant activation of FX, raw data collected with the SoftMax Pro application (Molecular Devices) were exported as .XML files. Further data linear and non-linear analyses were performed with XLfit4, a software package for automated curve fitting and statistical analysis within the Microsoft Excel spreadsheet environment (IDBS Software).

For data collected using the linear range assay, the $k_{cat}/K_m$ ($M^{-1}sec^{-1}$) kinetic constants are calculated directly from the slope of linear regression analyses of the FX concentration versus the velocity of the fluorogenic substrate cleavage (in µM/sec$^2$) where $k_{cat}/K_m$=slope/[FVIIa]×0.5×k$_2$. The correction factor k$_2$ was determined to be 45 using the method described in section A of Example 4 and kinetic constants for FXa cleavage of Spectrofluor FXa of $k_{cat,FXa}$=56 sec$^{-1}$ and $K_{m,\ FXa}$=126 nM, determined experimentally with activated FX (FXa) that was previously active site titrated with AT-III/heparin. Excluding data points that resulted in R$^2$ values less than 0.98 ensured the linearity of the data sets used in the fitting routine.

Analyses of data collected using the hyperbolic range assay were calculated from non-linear regression analyses of the FX concentration versus the velocity of the fluorogenic substrate cleavage (in µM/sec$^2$). The individual $k_{cat}$ and $K_m$ parameters are calculated as fit parameters using the Michaelis Menton hyperbolic equation of the form $(V_{max}/(1+(K_m/x)))$ where $k_{cat}$=V$_{max}$/[FVIIa]×0.5×k$_2$. The kinetic constant, $k_{cat}/K_M$ was calculated from the individual $k_{cat}$ and $K_m$ fitted parameters.

Tissue Factor-Independent Indirect Assay

The catalytic activity of the FVIIa variants in the presence of tissue factor was assessed in an indirect assay similar to that described above except that tissue factor was not included in the assay. Thus, the assay to assess TF-independent activity was performed essentially as described above, with the following modifications. The FVIIa variant solutions were diluted to 50 nM (or 5 nM for variants expected to have high TF-independent activity). Twenty-five µL of each FVIIa solution was mixed with 25 µL of a substrate solution that contained 1.0 mM Spectrofluor FXa (American Diagnostica) and one of 1050 nM, 700 nM, 466.7 nM, 311.1 nM, 207.4 nM, 138.3 nM, 92.2 nM or 0 nM of Factor X (Molecular Innovations). Thus, the final concentrations for the assay were 25 nM FVIIa (or 2.5 nM for high activity variants), 0.5 mM Spectrofluor FXa and 525 nM, 350 nM, 233.3 nM, 155.6 nM, 103.7 nM, 69.1 nM, 46.1 nM or 0 nM of Factor X (Molecular Innovations) in 50 µL/well. Data analyses were performed as described for the linear range assay, above with no modifications.

Table 14 provides the catalytic activity of FVIIa variants as measured in a TF-dependent Indirect Assay using FVIIa polypeptides expressed from 293-F cells and BHK-21 cells, and the catalytic activity as measured in a TF-independent Indirect Assay using FVIIa polypeptides expressed from 293-F cells and/or BHK-21 cells. The results are presented as the kinetic constant for catalytic activity, $k_{cat}/K_m$ ($M^{-1}sec^{-1}$), and also expressed as a percentage of the activity of the wild-type FVIIa, wherein the activity is catalytic activity, $k_{cat}/K_m$ ($M^{-1}sec^{-1}$) of each FVIIa variant for its substrate, FX. The use of the linear or hyperbolic range data analysis also is indicated for the values presented in the tables. Not all FVIIa variants were assayed in each assay. Several FVIIa variants exhibited increased catalytic activity compared to the wild-type FVIIa molecule. For example, the FVIIa polypeptide containing just the Q286R mutation (Q286R-FVIIa), has a catalytic activity of between 2 and 3 times that of wild-type FVIIa, and the FVIIa polypeptide containing the Q286R and M298Q mutations (Q286R/M298Q-FVIIa), has a catalytic activity of over 3 times that of wild-type FVIIa.

TABLE 14

Catalytic activity of FVIIa variants

| Mutation (mature FVII numbering) | Mutation (Chymotrypsin numbering) | Assay Format | $k_{cat}/K_M$ ($M^{-1}s^{-1}$) | $k_{cat}/K_M$ (% WT) |
|---|---|---|---|---|
| TF-Dependent Indirect Assay with FVIIa polypeptides from 293-F cells | | | | |
| Q286N | Q143N | hyperbolic | 4.88 × 10$^7$ | 100 |
| Q286E | Q143E | hyperbolic | 1.14 × 10$^7$ | 23 |
| Q286D | Q143D | hyperbolic | 6.04 × 10$^6$ | 12 |
| Q286S | Q143S | hyperbolic | 4.64 × 10$^7$ | 95 |
| Q286T | Q143T | hyperbolic | 2.44 × 10$^7$ | 50 |
| Q286R | Q143R | linear | 1.11 × 10$^8$ | 323 |
| Q286K | Q143K | hyperbolic | 5.44 × 10$^7$ | 112 |
| Q286A | Q143A | hyperbolic | 8.55 × 10$^7$ | 175 |
| Q286V | Q143V | hyperbolic | 1.65 × 10$^7$ | 34 |
| H216S | H76S | linear | 4.74 × 10$^7$ | 138 |
| H216A | H76A | linear | 5.98 × 10$^7$ | 175 |
| H216K | H76K | hyperbolic | 6.51 × 10$^7$ | 133 |

TABLE 14-continued

Catalytic activity of FVIIa variants

| | | | | |
|---|---|---|---|---|
| H216R | H76R | hyperbolic | $9.44 \times 10^7$ | 193 |
| S222A | S82A | linear | $5.73 \times 10^7$ | 167 |
| S222K | S82K | linear | $8.02 \times 10^7$ | 234 |
| H257A | H117A | linear | $3.90 \times 10^7$ | 114 |
| H257S | H117S | linear | $5.90 \times 10^7$ | 172 |
| K161S | K24S | hyperbolic | $5.99 \times 10^7$ | 123 |
| K161A | K24A | linear | $4.22 \times 10^7$ | 123 |
| K161V | K24V | hyperbolic | $5.45 \times 10^7$ | 112 |
| H373D | H224D | linear | $1.79 \times 10^7$ | 52 |
| H373E | H224E | linear | $2.79 \times 10^7$ | 81 |
| H373S | H224S | linear | $2.75 \times 10^7$ | 80 |
| H373F | H224F | linear | $5.11 \times 10^7$ | 149 |
| H373A | H224A | linear | $3.11 \times 10^7$ | 91 |
| S52A | S[52]A | linear | $4.66 \times 10^7$ | 136 |
| S60A | S[60]A | linear | $5.15 \times 10^7$ | 150 |
| Q366D | Q217D | linear | $1.88 \times 10^7$ | 55 |
| Q366E | Q217E | linear | $4.77 \times 10^7$ | 139 |
| Q366N | Q217N | linear | $5.64 \times 10^7$ | 165 |
| Q366T | Q217T | linear | $3.42 \times 10^7$ | 100 |
| Q366S | Q217S | linear | $2.70 \times 10^7$ | 79 |
| Q366V | Q217V | linear | $6.59 \times 10^7$ | 192 |
| E394N/P395A/R396S | E245N/P246A/R247S | linear | $5.32 \times 10^7$ | 155 |
| R202S | R62S | linear | $2.57 \times 10^7$ | 75 |
| A292N/A294S | A150N/A152S | linear | 0 | 0 |
| G318N | G170fN | linear | $5.50 \times 10^7$ | 161 |
| A175S | A39S | linear | $3.32 \times 10^7$ | 97 |
| K109N | K[109]N | linear | $5.97 \times 10^7$ | 174 |
| A122N/G124S | A[122]N/G[124]S | linear | $5.27 \times 10^7$ | 154 |
| T130N/E132S | T[130]N/E[132]S | linear | $6.35 \times 10^7$ | 185 |
| A122N/G124S/ E394N/P395A/R396S | A[122]N/G[124]S/E245N/P246A/ R247S | linear | $4.88 \times 10^7$ | 142 |
| V158T/L287T/M298K | V21T/L144T/M156K | linear | $4.50 \times 10^6$ | 13 |
| V158D/L287T/M298K | V21D/L144T/M156K | linear | $4.48 \times 10^6$ | 13 |
| S103S111delinsSFGRGDIRNV | S[103]S[111]delinsSFGRGDIRNV | linear | $4.83 \times 10^7$ | 141 |
| P406insCSFGRGDIRNVC | P257insCSFGRGDIRNVC | linear | $6.16 \times 10^7$ | 180 |
| P406insGGGSCSFGRGDIRNVC | P257insGGGSCSFGRGDIRNVC | linear | $7.47 \times 10^7$ | 218 |
| T128N/P129A | T[128]N/P[129]A | linear | $5.96 \times 10^7$ | 174 |
| S222A/Gla Swap FIX | S82A/Gla swap FIX | linear | $6.55 \times 10^7$ | 189 |
| H257A/Gla Swap FIX | H117A/Gla swap FIX | linear | $6.45 \times 10^7$ | 186 |
| S222A/H257A/Gla Swap FIX | S82A/H117A/Gla swap FIX | linear | $5.77 \times 10^7$ | 168 |
| Q286R/Gla Swap FIX | Q143R/Gla swap FIX | linear | $1.11 \times 10^8$ | 323 |
| Q286R/H257A | Q143R/H117A | linear | $1.27 \times 10^8$ | 371 |
| Q286R/S222A | Q143R/S82A | linear | $1.42 \times 10^8$ | 415 |
| Q286R/S222A/H257A | Q143R/S82A/H117A | linear | $9.51 \times 10^7$ | 278 |
| Q286R/S222A/Gla Swap FIX | Q143R/S82A/Gla swap FIX | linear | $1.61 \times 10^8$ | 470 |
| Q286R/H257A/Gla Swap FIX | Q143R/H117A/Gla swap FIX | linear | $8.09 \times 10^7$ | 234 |
| Q286R/S222A/H257A/Gla Swap FIX | Q143R/S82A/H117A/Gla swap FIX | linear | $7.75 \times 10^7$ | 226 |
| Q286R/M298Q/K341Q | Q143R/M156Q/K192Q | linear | $3.93 \times 10^7$ | 115 |
| Q286R/M298Q/K199E | Q143R/M156Q/K60cE | linear | $7.74 \times 10^7$ | 226 |
| T239S | T99S | linear | $1.74 \times 10^7$ | 51 |
| T239Q | T99Q | linear | $1.74 \times 10^7$ | 51 |
| T239V | T99V | linear | $9.57 \times 10^7$ | 279 |
| T239L | T99L | linear | $3.77 \times 10^7$ | 110 |
| T239H | T99H | linear | $9.90 \times 10^6$ | 29 |
| T239I | T99I | linear | $3.50 \times 10^7$ | 102 |
| S222A/H257A/M298Q | S82A/H117A/M156Q | linear | $7.75 \times 10^7$ | 224 |
| S222A/H257A/Q286R/M298Q | S82A/H117A/Q143R/M156Q | linear | $2.00 \times 10^8$ | 583 |
| S222A/H257A | S82A/H117A | linear | $5.02 \times 10^7$ | 147 |
| A175S/Q286R/Q366V | A39S/Q143R/Q217V | linear | $8.08 \times 10^7$ | 236 |
| A175S/S222A/Q366V | A39S/S82A/Q217V | linear | $3.78 \times 10^7$ | 109 |
| K109N/A175S | K[109]N/A39S | linear | $3.67 \times 10^7$ | 107 |
| S222A/Q286R/Q366V | S82A/Q143R/Q217V | linear | $1.27 \times 10^8$ | 369 |
| Q286M | Q143M | linear | $5.25 \times 10^7$ | 153 |
| Q286L | Q143L | linear | $2.02 \times 10^7$ | 59 |
| Q286Y | Q143Y | linear | $1.61 \times 10^7$ | 47 |
| Q366I | Q217I | linear | $9.37 \times 10^7$ | 274 |
| Q366L | Q217L | linear | $6.87 \times 10^7$ | 201 |
| Q366M | Q217M | linear | $6.61 \times 10^7$ | 193 |
| S222V | S82V | linear | $6.04 \times 10^7$ | 176 |
| S222D | S82D | linear | $5.34 \times 10^7$ | 156 |
| S222N | S82N | linear | $6.82 \times 10^7$ | 199 |
| S222E | S82E | linear | $5.48 \times 10^7$ | 160 |
| H216A/H257A | H76A/H117A | linear | $6.62 \times 10^7$ | 193 |
| H216A/S222A | H76A/S82A | linear | $5.46 \times 10^7$ | 159 |
| H257S/Q286R | H117S/Q143R | linear | $3.93 \times 10^7$ | 115 |

TABLE 14-continued

| Catalytic activity of FVIIa variants | | | | |
|---|---|---|---|---|
| H257S/Q366V | H117S/Q217V | linear | $6.71 \times 10^7$ | 194 |
| H257S/Q286R/Q366V | H117S/Q143R/Q217V | linear | $1.58 \times 10^8$ | 457 |
| S222A/H257A/Q286R/Q366V | S82A/H117A/Q143R/Q217V | linear | $1.86 \times 10^8$ | 538 |
| Q366V/H373V | Q217V/H224V | linear | $1.84 \times 10^7$ | 53 |
| Q366V/H373L | Q217V/H224L | linear | $3.07 \times 10^7$ | 89 |
| Q286R/H373A | Q143R/H224A | linear | $5.89 \times 10^7$ | 172 |
| S222A/H373A | S82A/H224A | linear | $3.64 \times 10^7$ | 106 |
| Q286R/M298Q/K341D | Q143R/M156Q/K192D | linear | $1.18 \times 10^7$ | 34 |
| Q286R/K341D | Q143R/K192D | linear | $1.11 \times 10^7$ | 32 |
| Q286R/Q366D | Q143R/Q217D | linear | $1.53 \times 10^7$ | 45 |
| Q286R/Q366N | Q143R/Q217N | linear | $5.42 \times 10^7$ | 158 |
| Q286R/M298Q/Q366D | Q143R/M156Q/Q217D | linear | $1.91 \times 10^7$ | 56 |
| Q286R/M298Q/Q366N | Q143R/M156Q/Q217N | linear | $1.04 \times 10^8$ | 305 |
| Q286R/H373F | Q143R/H224F | linear | $9.08 \times 10^7$ | 265 |
| Q286R/M298Q/H373F | Q143R/M156Q/H224F | linear | $1.51 \times 10^8$ | 440 |
| M298Q/H373F | M156Q/H224F | linear | $8.49 \times 10^7$ | 248 |
| S119N/L121S/A175S | S[119]N/L[121]S/A39S | linear | $2.92 \times 10^7$ | 85 |
| T128N/P129A/A175S | T[128]N/P[129]A/A39S | linear | $2.98 \times 10^7$ | 87 |
| A122N/G124S/A175S | A[122]N/G[124]S/A39S | linear | $2.79 \times 10^7$ | 81 |
| M298Q | M156Q | linear | $1.4 \times 10^8$ | 409 |
| TF-Dependent Indirect Assay with FVIIa polypeptides from BHK-21 cells | | | | |
| WT | WT | linear | $5.42 \times 10^7$ | 100 |
| Q286R | Q143R | linear | $1.01 \times 10^8$ | 187 |
| H216A | H76A | linear | $5.98 \times 10^7$ | 110 |
| S222A | S82A | linear | $6.42 \times 10^7$ | 118 |
| H257A | H117A | linear | $4.96 \times 10^7$ | 91 |
| H257S | H117S | linear | $7.65 \times 10^7$ | 141 |
| H373F | H224F | linear | $4.82 \times 10^7$ | 89 |
| S52A | S[52]A | linear | $3.50 \times 10^7$ | 65 |
| S60A | S[60]A | linear | $3.22 \times 10^7$ | 59 |
| Q366D | Q217D | linear | $9.80 \times 10^6$ | 18 |
| Q366N | Q217N | linear | $3.44 \times 10^7$ | 63 |
| Q366V | Q217V | linear | $1.86 \times 10^8$ | 342 |
| G318N | G170fN | linear | $5.46 \times 10^7$ | 101 |
| A175S | A39S | linear | $2.12 \times 10^7$ | 39 |
| A122N/G124S | A[122]N/G[124]S | linear | $8.05 \times 10^7$ | 148 |
| A51N | A[51]N | linear | $1.02 \times 10^8$ | 188 |
| S52A/S60A | S[52]A/S[60]A | linear | $1.05 \times 10^8$ | 193 |
| P406insGGGSCSFGRGDIRNVC | P257insGGGSCSFGRGDIRNVC | linear | $9.54 \times 10^7$ | 176 |
| S119N/L121S | S[119]N/L[121]S | linear | $5.75 \times 10^7$ | 106 |
| T128N/P129A | T[128]N/P[129]A | linear | $8.76 \times 10^7$ | 161 |
| Q286R/S222A | Q143R/S82A | linear | $1.24 \times 10^8$ | 229 |
| Q286R/S222A/H257A | Q143R/S82A/H117A | linear | $1.06 \times 10^8$ | 196 |
| Q286R/S222A/Gla Swap FIX | Q143R/S82A/Gla swap FIX | linear | $8.52 \times 10^7$ | 157 |
| Q286R/M298Q | Q143R/M156Q | linear | $1.85 \times 10^8$ | 341 |
| Q286R/M298Q/K341Q | Q143R/M156Q/K192Q | linear | $3.11 \times 10^7$ | 57 |
| Q286R/M298Q/K199E | Q143R/M156Q/K60cE | linear | $9.18 \times 10^7$ | 169 |
| P321K | P170iK | linear | $3.43 \times 10^7$ | 63 |
| P321E | P170iE | linear | $5.59 \times 10^7$ | 103 |
| P321Y | P170iY | linear | $4.48 \times 10^7$ | 83 |
| P321S | P170iS | linear | $5.53 \times 10^7$ | 102 |
| T239N | T99N | linear | $1.64 \times 10^7$ | 30 |
| T239Q | T99Q | linear | $1.70 \times 10^7$ | 31 |
| T239V | T99V | linear | $9.81 \times 10^7$ | 181 |
| T239L | T99L | linear | $5.24 \times 10^7$ | 97 |
| T239H | T99H | linear | $1.25 \times 10^7$ | 23 |
| T239I | T99I | linear | $4.67 \times 10^7$ | 86 |
| S222A/M298Q | S82A/M156Q | linear | $7.13 \times 10^7$ | 131 |
| H257A/M298Q | H117A/M156Q | linear | $1.28 \times 10^8$ | 236 |
| S222A/H257A/Q286R/M298Q | S82A/H117A/Q143R/M156Q | linear | $1.94 \times 10^8$ | 358 |
| Q286R/M298Q/Gla Swap FIX | Q143R/M156Q/Gla swap FIX | linear | $2.64 \times 10^8$ | 487 |
| Q286R/Q366V | Q143R/Q217V | linear | $7.92 \times 10^7$ | 146 |
| A175S/Q286R/Q366V | A39S/Q143R/Q217V | linear | $7.63 \times 10^7$ | 141 |
| K109N/A175S | K[109]N/A39S | linear | $2.45 \times 10^7$ | 45 |
| S222A/Q286R/Q366V | S82A/Q143R/Q217V | linear | $1.44 \times 10^8$ | 265 |
| Q286R/M298Q/K341D | Q143R/M156Q/K192D | linear | $1.35 \times 10^7$ | 25 |
| Q286R/H373F | Q143R/H224F | linear | $1.18 \times 10^8$ | 218 |
| Q286R/M298Q/H373F | Q143R/M156Q/H224F | linear | $2.01 \times 10^8$ | 371 |
| M298Q/H373F | M156Q/H224F | linear | $8.69 \times 10^7$ | 160 |
| A122N/G124S/A175S | A[122]N/G[124]S/A39S | linear | $1.93 \times 10^7$ | 36 |
| M298Q | M156Q | linear | $9.34 \times 10^7$ | 172 |

TABLE 14-continued

Catalytic activity of FVIIa variants

TF-Independent Indirect Assay

| Mutation (mature FVII numbering) | Mutation (Chymotrypsin numbering) | 293-F Cells $k_{cat}/K_M$ $(M^{-1}s^{-1})$ | 293-F Cells $k_{cat}/K_M$ (% WT) | BHK-21 Cells $k_{cat}/K_M$ $(M^{-1}s^{-1})$ | BHK-21 Cells $k_{cat}/K_M$ (% WT) |
|---|---|---|---|---|---|
| WT | WT | $2.26 \times 10^1$ | 100 | $1.58 \times 10^1$ | 100 |
| Q286N | Q143N | $3.03 \times 10^1$ | 134 | | |
| Q286E | Q143E | 4.80 | 21 | | |
| Q286D | Q143D | $3.50 \times 10^{-1}$ | 2 | | |
| Q286S | Q143S | $2.66 \times 10^1$ | 118 | | |
| Q286T | Q143T | $1.51 \times 10^1$ | 67 | | |
| Q286R | Q143R | $4.87 \times 10^1$ | 215 | $4.08 \times 10^1$ | 259 |
| Q286K | Q143K | $3.95 \times 10^1$ | 175 | | |
| Q286A | Q143A | $2.11 \times 10^1$ | 93 | | |
| Q286V | Q143V | 2.35 | 10 | | |
| S222A | S82A | $7.36 \times 10^1$ | 326 | $3.10 \times 10^1$ | 197 |
| H257A | H117A | $2.02 \times 10^1$ | 89 | $1.18 \times 10^1$ | 75 |
| H257S | H117S | $1.75 \times 10^1$ | 77 | $1.33 \times 10^1$ | 84 |
| Q366D | Q217D | 6.30 | 28 | 2.30 | 15 |
| Q366E | Q217E | $2.38 \times 10^1$ | 105 | | |
| Q366N | Q217N | $2.26 \times 10^1$ | 100 | $1.36 \times 10^1$ | 86 |
| Q366T | Q217T | $2.48 \times 10^1$ | 110 | | |
| Q366S | Q217S | $1.02 \times 10^1$ | 45 | | |
| Q366V | Q217V | $2.90 \times 10^1$ | 128 | $8.36 \times 10^1$ | 530 |
| A51N | A[51]N | | | $2.07 \times 10^1$ | 91 |
| V158T/L287T/M298K | V21T/L144T/M156K | 4.65 | 21 | | |
| V158D/L287T/M298K | V21D/L144T/M156K | 2.50 | 11 | | |
| S52A/S60A | S[52]A/S[60]A | | | $1.68 \times 10^1$ | 106 |
| T128N/P129A | T[128]N/P[129]A | | | $1.43 \times 10^1$ | 91 |
| Q286R/Gla Swap FIX | Q143R/Gla swap FIX | $4.37 \times 10^1$ | 193 | | |
| Q286R/H257A | Q143R/H117A | $1.07 \times 10^1$ | 47 | | |
| Q286R/S222A | Q143R/S82A | $1.00 \times 10^2$ | 444 | $3.18 \times 10^1$ | 202 |
| Q286R/S222A/H257A | Q143R/S82A/H117A | | | $9.60 \times 10$ | 61 |
| Q286R/S222A/Gla Swap FIX | Q143R/S82A/Gla swap FIX | $1.82 \times 10^2$ | 804 | $3.63 \times 10^1$ | 230 |
| Q286R/S222A/H257A/Gla Swap FIX | Q143R/S82A/H117A/Gla swap FIX | $2.79 \times 10^1$ | 123 | | |
| Q286R/M298Q | Q143R/M156Q | | | $3.02 \times 10^2$ | 1916 |
| Q286R/M298Q/K341Q | Q143R/M156Q/K192Q | $1.50 \times 10^2$ | 665 | $3.65 \times 10^2$ | 2319 |
| Q286R/M298Q/K199E | Q143R/M156Q/K60cE | $8.69 \times 10^1$ | 385 | $2.29 \times 10^2$ | 1451 |
| P321K | P170iK | | | $1.13 \times 10^1$ | 71 |
| S222A/M298Q | S82A/M156Q | | | $7.85 \times 10^2$ | 4981 |
| H257A/M298Q | H117A/M156Q | | | $4.12 \times 10^1$ | 262 |
| S222A/H257A/Q286R/M298Q | S82A/H117A/Q143R/M156Q | $6.09 \times 10^2$ | 2695 | $1.90 \times 10^2$ | 1208 |
| Q286R/M298Q/Gla Swap FIX | Q143R/M156Q/Gla swap FIX | | | $7.52 \times 10^2$ | 4775 |
| Q286R/Q366V | Q143R/Q217V | | | $2.38 \times 10^1$ | 151 |
| A175S/Q286R/Q366V | A39S/Q143R/Q217V | $3.87 \times 10^1$ | 171 | $1.23 \times 10^1$ | 78 |
| S222A/Q286R/Q366V | S82A/Q143R/Q217V | | | $3.21 \times 10^1$ | 204 |
| Q286M | Q143M | $1.07 \times 10^1$ | 47 | | |
| Q286L | Q143L | 3.20 | 14 | | |
| Q286Y | Q143Y | $9.50 \times 10^{-1}$ | 4 | | |
| Q366I | Q217I | $6.29 \times 10^1$ | 278 | | |
| Q366L | Q217L | $2.54 \times 10^1$ | 112 | | |
| Q366M | Q217M | $4.05 \times 10^1$ | 179 | | |
| Q286R/K341D | Q143R/K192D | 1.80 | 8 | | |
| Q286R/Q366D | Q143R/Q217D | 1.00 | 4 | | |
| Q286R/Q366N | Q143R/Q217N | 2.75 | 12 | | |
| Q286R/M298Q/Q366D | Q143R/M156Q/Q217D | 6.80 | 30 | | |
| Q286R/M298Q/Q366N | Q143R/M156Q/Q217N | $2.12 \times 10^1$ | 94 | | |
| Q286R/H373F | Q143R/H224F | | | $2.20 \times 10^1$ | 139 |
| Q286R/M298Q/H373F | Q143R/M156Q/H224F | $2.16 \times 10^2$ | 957 | $3.17 \times 10^2$ | 2009 |
| M298Q/H373F | M156Q/H224F | | | $2.36 \times 10^2$ | 1499 |
| M298Q | M156Q | $4.59 \times 10^2$ | 2029 | $3.1 \times 10^2$ | 1969 |

In a further set of experiments, the catalytic activity of FVIIa polypeptides produced in BHK-21 cells was analyzed using the TF-independent and TF-dependent indirect assays described above with minor modifications. Several variants were produced in CHOX cells in addition to BHK-21 cells or exclusively in CHOX cells. The variants were assayed under identical conditions regardless of the celline used. For the TF-dependent catalytic assay (using linear analysis), the FVIIa polypeptides were first active site titrated with 4-methylumbelliferyl p'-guanidinobenzoate (MUGB) to determine the FVIIa concentration, as described in Example 12, below. To maximize the number of data points in the linear range, the maximal concentration of FX in the assay was set to 25 nM (ie. 0-25 nM instead of 0-150 nM). The FX used in the assay was activated (i.e. FXa) and titrated with fluorescein-mono-p'-guanidinobenzoate (FMGB), as described in Example 15, below. The kinetic constants for cleavage of Spectrafluor FXa substrate were determined on this active site titrated FXa and demonstrated to be: $K_m$ of 190.2 µM and a $k_{cat}$ of 340 s$^{-1}$. The primary difference being in $k_{cat}$ and mostly due to the improved active site determinations. These parameters give a revised $k_2$ correction factor value of 246.4 that is used in the linear analysis to determine the catalytic activity of the FVIIa polypeptides in the presence of TF.

For the TF-independent catalytic assay, the FVIIa polypeptides were first active site titrated with 4-methylumbelliferyl p'-guanidinobenzoate (MUGB) to determine the FVIIa concentration, as described in Example 12, below. The FX used in the assay was activated (i.e. FXa) and titrated with fluorescein-mono-p'-guanidinobenzoate (FMGB), as described in Example 15. The kinetic constants for cleavage of Spectrafluor FXa substrate were determined on this active site titrated FXa and demonstrated to be: $K_m$ of 190.2 µM and a $k_{cat}$ of 340 s$^{-1}$. These parameters give a revised $k_2$ correction factor value of 246.4 that is used in the analysis to determine the catalytic activity of the FVIIa polypeptides in the absence of TF.

Table 15 sets forth the catalytic activity of each of the FVIIa variant polypeptides assayed. The results are presented as the kinetic constant for catalytic activity, $k_{cat}/K_m$ (M$^{-1}$sec$^{-1}$), and also expressed as a percentage of the activity of the wild-type FVIIa, wherein the activity is catalytic activity, $k_{cat}/K_m$ (M$^{-1}$sec$^{-1}$) of each FVIIa variant for its substrate, FX. The standard deviation (SD), coefficient of variation (as a percentage; % CV) and the number of assays performed (n) also are provided. Some of the variants displayed markedly increased catalytic activity compared to the wildtype FVII polypeptide. For example, the Gla swap FIX/Q286R/M298Q variant exhibited a TF-dependent catalytic activity over 6 times that of the wild type FVII polypeptide. The increased catalytic activity of the FVIIa variants was more pronounced in the TF-independent assay. For example, the Gla swapFIX/Q366V variants had over 9 times more catalytic activity than wild-type FVIIa, the Gla swap FIX/Q286R/M298Q, {Gla swap FIX/E40L}/Q286R/M298Q, {Gla swap FIX/K43I}/Q286R/M298Q, and {Gla swap FIX/Q44S}/Q286R/M298Q variants had over 70-80 times more catalytic activity than wild-type FVIIa, and the S52A/S60A/V158D/E296V/M1298Q variant had over 220 times more catalytic activity than wild-type FVIIa.

TABLE 15

Catalytic activity of FVIIa variants

| Mutation (mature FVII numbering) | Mutation (Chymotrypsin numbering) | $k_{cat}/K_M$ (M$^{-1}$s$^{-1}$) | SD | % CV | $k_{cat}/K_M$ (% WT) | n |
|---|---|---|---|---|---|---|
| TF-dependent assay | | | | | | |
| WT (NovoSeven ®) | WT (NovoSeven ®) | 3.98E+07 | 1.02E+07 | 26% | 106% | 30 |
| WT (NovoSeven-RT ®) | WT (NovoSeven-RT ®) | 3.48E+07 | 8.33E+06 | 24% | 93% | 10 |
| WT | WT | 3.75E+07 | 5.44E+06 | 15% | 100% | 13 |
| WT† | WT† | 3.76E+07 | 7.09E+06 | 19% | 100% | 10 |
| T128N/P129A | T[128]N/P[129]A | 4.65E+07 | 1.09E+07 | 23% | 124% | 5 |
| Gla swap FIX | Gla swap FIX | 5.38E+07 | 9.08E+05 | 2% | 144% | 2 |
| K109N | K[109]N | 5.54E+07 | 8.57E+06 | 15% | 148% | 2 |
| A122N/G124S | A[122]N/G[124]S | 3.87E+07 | 4.96E+06 | 13% | 103% | 2 |
| S52A/S60A | S[52]A/S[60]A | 3.56E+07 | 4.63E+06 | 13% | 95% | 2 |
| M298Q | M156Q | 6.76E+07 | 7.38E+06 | 11% | 180% | 6 |
| M298Q† | M156Q† | 7.46E+07 | 9.42E+06 | 13% | 198% | 4 |
| T128N/P129A/M298Q† | T[128]N/P[129]A/M156Q† | 6.29E+07 | 1.28E+07 | 20% | 167% | 4 |
| V158D/E296V/M298Q | V21D/E154V/M156Q | 1.81E+08 | 4.43E+07 | 25% | 482% | 8 |
| V158D/E296V/M298Q† | V21D/E154V/M156Q† | 1.65E+08 | 4.08E+07 | 25% | 441% | 10 |
| T128N/P129A/V158D/E296V/M298Q | T[128]N/P[129]A/V21D/E154V/M156Q | 2.01E+08 | 1.54E+07 | 8% | 537% | 4 |
| S52A/S60A/V158D/E296V/M1298Q | S[52]A/S[60]A/V21D/E154/M156Q | 2.00E+08 | 4.31E+05 | 0% | 532% | 2 |
| Q286R | Q143R | 8.06E+07 | 1.43E+07 | 18% | 215% | 5 |
| T128N/P129A/Q286R | T[128]N/P[129]A/Q143R | 8.45E+07 | 1.90E+07 | 22% | 226% | 6 |
| T128N/P129A/Q286R† | T[128]N/P[129]A/Q143R† | 6.20E+07 | | | 165% | 1 |
| S52A/S60A/Q286R | S[52]A/S[60]A/Q143R | 4.10E+07 | 6.71E+06 | 16% | 109% | 4 |
| S222A | S82A | 4.07E+07 | 1.17E+07 | 29% | 109% | 4 |
| T128N/P129A/S222A | T[128]N/P[129]A/S82A | 6.25E+07 | 6.78E+06 | 11% | 167% | 4 |
| S52A/S60A/S222A | S[52]A/S[60]A/S82A | 3.91E+07 | 8.75E+06 | 22% | 104% | 3 |
| H257S | H117S | 1.18E+08 | 2.02E+07 | 17% | 316% | 2 |
| H373F | H224F | 5.58E+07 | 2.05E+07 | 37% | 149% | 2 |
| Q366V | Q217V | 5.48E+07 | 2.69E+06 | 5% | 146% | 2 |
| Gla swapFIX/Q366V | Gla swapFIX/Q217V | 9.11E+07 | 2.50E+07 | 27% | 243% | 3 |
| A175S | A39S | 2.11E+07 | 6.10E+06 | 29% | 56% | 3 |
| K109N/A175S | K[109]N/A39S | 1.74E+07 | 4.29E+06 | 25% | 46% | 5 |
| S119N/L121S/A175S | S[119]N/L[121]S/A39S | 1.73E+07 | 1.28E+06 | 7% | 46% | 2 |
| T128N/P129A/A175S | T[128]N/P[129]A/A39S | 8.59E+06 | 1.82E+06 | 21% | 23% | 2 |
| A122N/G124S/A175S | A[122]N/G[124]S/A39S | 1.05E+07 | 1.12E+06 | 11% | 28% | 2 |
| Q286R/H257A | Q143R/H117A | 9.91E+07 | 1.74E+07 | 18% | 264% | 2 |
| Q286R/H257A† | Q143R/H117A† | 3.08E+07 | 1.52E+07 | 49% | 82% | 4 |
| Q286R/S222A | Q143R/S82A | 1.11E+08 | 3.21E+07 | 29% | 296% | 4 |
| Gla swap FIX/T128N/P129A/S222A/Q286R | Gla swap FIX/T[128]N/P[129]A/S82A/Q143R | 1.47E+08 | 2.53E+07 | 17% | 393% | 3 |
| Gla swap FIX/T128N/P129A/S222A/Q286R† | Gla swap FIX/T[128]N/P[129]A/S82A/Q143R† | 1.43E+08 | 1.63E+07 | 11% | 379% | 2 |

TABLE 15-continued

Catalytic activity of FVIIa variants

| Mutation (mature FVII numbering) | Mutation (Chymotrypsin numbering) | $k_{cat}/K_M$ ($M^{-1}s^{-1}$) | SD | % CV | $k_{cat}/K_M$ (% WT) | n |
|---|---|---|---|---|---|---|
| Gla swap FIX/S52A/S60A/S222A/Q286R | Gla swap FIX/S[52]A/S[60]A/S82A/Q143R | 7.24E+07 | 2.36E+06 | 3% | 193% | 2 |
| Q286R/S222A/H257A | Q143R/S82A/H117A | 6.98E+07 | 1.64E+07 | 23% | 186% | 3 |
| Q286R/M298Q | Q143R/M156Q | 1.66E+08 | 3.86E+07 | 23% | 442% | 14 |
| Q286R/M298Q† | Q143R/M156Q† | 1.34E+08 | 2.37E+07 | 18% | 356% | 15 |
| Q286R/M298Q§ | Q143R/M156Q§ | 1.54E+08 | 3.86E+07 | 25% | 408% | 6 |
| Gla swap FIX/Q286R/M298Q | Gla swap FIX/Q143R/M156Q | 2.55E+08 | 6.16E+07 | 24% | 680% | 6 |
| Gla swap FIX/Q286R/M298Q† | Gla swap FIX/Q143R/M156Q† | 2.30E+08 | 5.10E+07 | 22% | 613% | 4 |
| T128N/P129A/Q286R/M298Q | T[128]N/P[129]A/Q143R/M156Q | 1.86E+08 | 2.64E+07 | 14% | 497% | 6 |
| T128N/P129A/Q286R/M298Q† | T[128]N/P[129]A/Q143R/M156Q† | 1.50E+08 | 4.16E+07 | 28% | 398% | 4 |
| Gla swap FIX/T128N/P129A/Q286R/M298Q | Gla swap FIX/T[128]N/P[129]A/Q143R/M156Q | 2.11E+08 | 4.41E+07 | 21% | 562% | 3 |
| Gla swap FIX/T128N/P129A/Q286R/M298Q† | Gla swap FIX/T[128]N/P[129]A/Q143R/M156Q† | 1.99E+08 | 6.79E+07 | 34% | 529% | 5 |
| {Gla swap FIX/E40L}/Q286R/M298Q | {Gla swap FIX/E[40]L}/Q143R/M156Q | 2.08E+08 | 4.39E+07 | 21% | 556% | 4 |
| {Gla swap FIX/K43I}/Q286R/M298Q | {Gla swap FIX/K[43]I}/Q143R/M156Q | 2.73E+08 | 5.21E+07 | 19% | 727% | 5 |
| {Gla swap FIX/K43I}/Q286R/M298Q† | {Gla swap FIX/K[43]I}/Q143R/M156Q† | 2.91E+08 | 4.30E+07 | 15% | 774% | 5 |
| {Gla swap FIX/Q44S}/Q286R/M298Q | {Gla swap FIX/Q[44]S}/Q143R/M156Q | 1.98E+08 | 2.75E+07 | 14% | 529% | 3 |
| {Gla swap FIX/M19K}/Q286R/M298Q | {Gla swap FIX/M[19]K}/Q143R/M156Q | 1.41E+08 | 5.22E+06 | 4% | 375% | 2 |
| S52A/S60A/Q286R/M298Q | S[52]A/S[60]A/Q143R/M156Q | 1.25E+08 | 1.14E+07 | 9% | 333% | 4 |
| Gla swap FIX/S52A/S60A/Q286R/M298Q† | Gla swap FIX/S[52]A/S[60]A/Q143R/M156Q† | 1.80E+08 | 1.81E+07 | 10% | 480% | 3 |
| {Gla swap FIX/M19K/E40L/K43I/Q44S}/Q286R/M298Q | {Gla swap FIX/M[19]K/E[40]L/K[43]I/Q[44]}/Q286R/M298Q | 1.21E+08 | 7.07E+06 | 6% | 322% | 2 |
| {Gla swap FIX/K43I}/T128N/P129A/Q286R/M298Q† | {Gla swap FIX/K[43]I}/T128N/P129A/Q143R/M156Q† | 2.71E+08 | 6.41E+07 | 24% | 720% | 5 |
| T239V | T99V | 4.64E+07 | 8.38E+06 | 18% | 124% | 2 |
| T239I | T99I | 2.62E+07 | 6.51E+06 | 25% | 70% | 2 |
| H257A/M298Q | H117A/Q143R/M156Q | 1.67E+08 | 4.27E+06 | 26% | 45% | 5 |
| S222A/H257A/Q286R/M298Q | S82A/H117A/Q143R/M156Q | 1.65E+08 | 1.76E+07 | 11% | 440% | 4 |
| T128N/P129A/S222A/H257A/Q286R/M298Q | T[128]N/P[129]A/S82A/H117A/Q143R/M156Q | 1.55E+08 | 5.77E+07 | 37% | 414% | 9 |
| T128N/P129A/S222A/H257A/Q286R/M298Q† | T[128]N/P[129]A/S82A/H117A/Q143R/M156Q† | 1.73E+08 | 1.41E+07 | 8% | 461% | 2 |
| S52A/S60A/S222A/H257A/Q286R/M298Q | S[52]A/S[60]A/S82A/H117A/Q143R/M156Q | 2.49E+08 | 8.78E+06 | 4% | 665% | 3 |
| H257S/Q286R/Q366V | H117S/Q143R/Q217V | 7.10E+07 | 3.16E+07 | 44% | 189% | 11 |
| S222A/H257A/Q286R/Q366V | S82A/H117A/Q143R/Q217V | 1.00E+08 | 1.03E+07 | 10% | 268% | 4 |
| Q286R/M298Q/Q366N | Q143R/M156Q/Q217N | 1.17E+08 | 3.05E+07 | 26% | 312% | 7 |
| T128N/P129A/Q286R/M298Q/Q366N† | T[129]N/P[129]A/Q143R/M156Q/Q217N† | 1.42E+08 | 4.17E+07 | 29% | 377% | 3 |
| {Gla swap FIX/K43I}/Q286R/M298Q/Q366N† | {Gla swap FIX/K[43]I}/Q143R/M156Q/Q217N† | 1.69E+08 | 3.89E+07 | 23% | 450% | 5 |
| {Gla swap FIX/K43I}/T128N/P129A/Q286R/M298Q/Q366N† | {Gla swap FIX/K[43]I}/T[128]N/P[129]A/Q143R/M156Q/Q217N† | 2.52E+08 | 1.36E+07 | 5% | 669% | 2 |
| Q286R/H373F | Q143R/H224F | 9.01E+07 | 7.73E+06 | 9% | 240% | 2 |
| T128N/P129A/Q286R/H373F | T[128]N/P[129]A/Q143R/H224F | 6.91E+07 | 2.15E+07 | 31% | 184% | 12 |
| S52A/S60A/Q286R/H373F | S[52]A/S[60]A/Q143R/H224F | 9.44E+07 | 1.43E+07 | 15% | 252% | 3 |
| Q286R/M298Q/H373F | Q143R/M156Q/H224F | 1.36E+08 | 1.92E+07 | 14% | 364% | 5 |
| T128N/P129A/Q286R/M298Q/H373F | T[128]N/P[129]A/Q143R/M156Q/H224F | 1.33E+08 | 4.77E+07 | 36% | 354% | 17 |
| S52A/S60A/Q286R/M298Q/H373F | S[52]A/S[60]A/Q143R/M156Q/H224F | 1.77E+08 | 3.63E+07 | 21% | 472% | 3 |
| M298Q/H373F | M156Q/H224F | 7.21E+07 | 1.76E+07 | 24% | 192% | 4 |
| T128N/P129A/M298Q/H373F† | T[128]N/P[129]A/M156Q/H224F† | 6.07E+07 | 1.29E+07 | 21% | 161% | 2 |
| V158D/Q286R/E296V/M298Q | V21D/Q143R/E154V/M156Q | 1.49E+08 | 3.59E+07 | 24% | 397% | 11 |

TABLE 15-continued

Catalytic activity of FVIIa variants

| Mutation (mature FVII numbering) | Mutation (Chymotrypsin numbering) | $k_{cat}/K_M$ ($M^{-1}s^{-1}$) | SD | % CV | $k_{cat}/K_M$ (% WT) | n |
|---|---|---|---|---|---|---|
| S222A/T239V | S82A/T99V | 7.49E+07 | 2.57E+06 | 3% | 200% | 3 |
| Gla swap FIX/ S222A/T239V/Q286R | Gla swap FIX/ S82A/T99V/Q143R | 2.03E+08 | 3.16E+07 | 16% | 541% | 3 |
| Gla swap FIX/ S222A/T239V/Q286R† | Gla swap FIX/ S82A/T99V/Q143R† | 9.94E+07 | 1.83E+07 | 18% | 264% | 3 |
| T239V/Q286R/M298Q | T99V/Q143R/M156Q | 1.72E+08 | 4.92E+07 | 29% | 459% | 5 |
| Gla swap FIX/ T239V/Q286R/M298Q | Gla swap FIX/ T99V/Q143R/M156Q | 2.53E+08 | 4.78E+07 | 19% | 675% | 3 |
| Gla swap FIX/ T239V/Q286R/M298Q† | Gla swap FIX/ T99V/Q143R/M156Q† | 1.79E+08 | 3.81E+07 | 21% | 477% | 4 |
| T128N/P129A/T239V/Q286R/ M298Q† | T[128]N/P[129]A/T99V/Q143R/ M156Q† | 1.04E+08 | 2.43E+07 | 23% | 276% | 4 |
| S222A/T239V/H257A/ Q286R/M298Q | S82A/T99V/H117A/Q143R/ M156Q | 2.14E+08 | 4.48E+07 | 21% | 571% | 5 |
| T128N/P129A/S222A/T239V/ H257A/ Q286R/M298Q† | T[128]N/P[129]A/S82A/T99V/ H117A/Q143R/M156Q† | 1.21E+08 | 5.58E+06 | 5% | 323% | 3 |
| T239V/Q286R/H373F | T99V/Q143R/H224F | 1.06E+08 | 1.34E+07 | 13% | 283% | 2 |
| T239V/Q286R/M298Q/H373F | T99V/Q143R/M156Q/H224F | 1.70E+08 | 1.13E+07 | 7% | 454% | 2 |
| T128N/P129A/T239V/Q286R/ M298Q/H373F† | T[128]N/P[129]A/T99V/Q143R/ M156Q/H224F† | 2.36E+08 | 2.77E+07 | 12% | 627% | 3 |
| V158D/T239I/E296V/M298Q | V21D/T99I/E154V/M156Q | 1.45E+08 | 1.18E+07 | 8% | 387% | 4 |
| T239I/Q286R | T99I/Q143R | 5.79E+07 | 1.39E+07 | 24% | 155% | 3 |
| S222A/T239I | S82A/T99I | 3.05E+07 | 9.26E+06 | 30% | 81% | 4 |
| GlaSwapFIX/S222A/T239I/ Q286R | Gla swap FIX/ S82A/T99I/Q143R | 6.77E+07 | 4.44E+06 | 7% | 181% | 2 |
| T239I/Q286R/M298Q | T99I/Q143R/M156Q | 1.13E+08 | 3.68E+06 | 3% | 301% | 2 |
| Gla swap FIX/ T239I/Q286R/M298Q | Gla swap FIX/ T99I/Q143R/M156Q | 1.25E+08 | 2.13E+07 | 17% | 334% | 2 |
| T128N/P129A/T239I/Q286R/ M298Q† | T[128]N/P[129]A/T99I/Q143R/ M156Q† | 8.17E+07 | 8.17E+06 | 10% | 217% | 3 |
| S222A/T239I/H257A/Q286R/ M298Q | S82A/T99I/H117A/Q143R/M156Q | 1.14E+08 | 2.22E+07 | 19% | 304% | 3 |
| T239I/Q286R/H373F | T99I/Q143R/H224F | 6.18E+07 | 9.27E+06 | 15% | 165% | 3 |
| V158D/T239V/E296V/M298Q | V21D/T99V/E154V/M156Q | 2.22E+08 | 1.39E+07 | 6% | 591% | 2 |
| V158D/T239V/E296V/M298Q† | V21D/T99V/E154V/M156Q† | 1.65E+08 | 2.12E+06 | 1% | 438% | 2 |
| T239V/Q286R | T99V/Q143R | 8.84E+07 | 7.16E+05 | 1% | 236% | 2 |
| T239I/Q286R/M298Q/ H237F | T99I/Q143R/M156Q/H224F | 1.08E+08 | 2.32E+07 | 21% | 289% | 7 |
| T128N/P129A/T239I/Q286R/ M298Q/H237F† | T[128]N/P[129]A/T99I/Q143R/ M156Q/H224F† | 1.30E+08 | 2.51E+07 | 19% | 345% | 5 |
| H257S/Q286R/M298Q | H117S/Q143R/M156Q | 1.40E+08 | 8.97E+06 | 6% | 372% | 4 |
| Gla swap FIX/ Q286R/S222A/H257S | Gla swap FIX/ Q143R/S82A/H117S | 8.53E+07 | 1.66E+07 | 20% | 227% | 3 |
| S222A/H257S/Q286R/ M298Q | S82A/H117S/Q143R/M156Q | 1.58E+08 | 1.76E+07 | 11% | 420% | 2 |
| H257S/Q286R/M298Q/ H373F | H117S/Q143R/M156Q/H224F | 1.52E+08 | 3.35E+07 | 22% | 407% | 7 |
| S222A/Q286R/M298Q/ H373F | S82A/Q143R/M156Q/H224F | 1.48E+08 | 2.23E+06 | 2% | 395% | 2 |
| Gla swap FIX/S222A/ Q286R/M298Q/H373F | Gla swap FIX S82A/Q143R/M156Q/H224F | 2.84E+08 | 4.85E+07 | 17% | 758% | 3 |
| S222A/Q286R/M298Q | S82A/Q143R/M156Q | 1.29E+08 | 1.86E+07 | 14% | 343% | 3 |
| Gla swap FIX/ S222A/Q286R/M298Q | Gla swap FIX S82A/Q143R/M156Q | 2.10E+08 | 4.28E+07 | 20% | 559% | 5 |
| T128N/P129A/A175S/ Q366V | T[128]N/P[129]A/A39S/Q217V | 3.38E+07 | 3.06E+06 | 9% | 90% | 2 |
| A122N/G124S/A175S/ Q366V | A[122]N/G[124]S/A39S/Q217V | 3.02E+07 | 7.05E+06 | 23% | 80% | 5 |
| T128N/P129A/A175S/ S222A | T[128]N/P[129]A/A39S/S82A | 1.72E+07 | 3.18E+06 | 18% | 46% | 3 |
| A122N/G124S/A175S/ S222A | A[122]N/G[124]S/A39S/S82A | 2.08E+07 | 5.05E+06 | 24% | 56% | 5 |
| T128N/P129A/A175S/ Q286R | T[128]N/P[129]A/A39S/Q143R | 3.33E+07 | 1.46E+06 | 4% | 89% | 3 |
| A122N/G124S/A175S/ Q286R | A[122]N/G[124]S/A39S/Q143R | 4.11E+07 | 5.27E+06 | 13% | 110% | 5 |
| Gla swap FIX/ S222A/Q286R/H373F | Gla swap FIX/ S82A/Q143R/H224F | 1.22E+08 | 3.17E+07 | 26% | 327% | 8 |
| V158D/E296V/M298Q/ H373F | V21D/E154V/M156Q/H224F | 1.51E+08 | 8.39E+06 | 6% | 402% | 3 |
| H257A/Q286R/M298Q | H117A/Q143R/M156Q | 1.13E+08 | 1.55E+07 | 14% | 301% | 3 |
| Gla swap FIX/ T128N/P129A/A175S/ S222A/Q286R | Gla swap FIX/ T[128]N/P[129]A/A39S/S82A/ Q143R | 3.88E+07 | 2.74E+06 | 7% | 104% | 3 |

TABLE 15-continued

Catalytic activity of FVIIa variants

| Mutation (mature FVII numbering) | Mutation (Chymotrypsin numbering) | $k_{cat}/K_M$ (M$^{-1}$s$^{-1}$) | SD | % CV | $k_{cat}/K_M$ (% WT) | n |
|---|---|---|---|---|---|---|
| Gla swap FIX/A122N/G124S/A175S/S222A/Q286R | Gla swap FIX/A[122]N/G[124]S/A39S/S82A/Q143R | 4.13E+07 | 8.99E+06 | 22% | 110% | 6 |
| T128N/P129A/A175S/Q286R/M298Q | T[128]N/P[129]A/A39S/Q143R/M156Q | 7.21E+07 | 1.14E+07 | 16% | 192% | 3 |
| A122N/G124S/A175S/Q286R/M298Q | A[122]N/G[124]S/A39S/Q143R/M156Q | 7.43E+07 | 1.10E+07 | 15% | 198% | 3 |
| T128N/P129A/A175S/S222A/H257A/Q286R/M298Q | T[128]N/P[129]A/A39S/S82A/H117A/Q143R/M156Q | 6.89E+07 | 3.36E+06 | 5% | 184% | 3 |
| A122N/G124S/A175S/S222A/H257A/Q286R/M298Q | A[122]N/G[124]S/A39S/S82A/H117A/Q143R/M156Q | 8.40E+07 | 5.72E+06 | 7% | 224% | 3 |
| T128N/P129A/A175S/Q286R/M298Q/H373F | T[128]N/P[129]A/A39S/Q143R/M156Q/H224F | 5.72E+07 | 3.36E+06 | 6% | 153% | 3 |
| A122N/G124S/A175S/Q286R/M298Q/H373F | A[122]N/G[124]S/A39S/Q143R/M156Q/H224F | 8.39E+07 | 9.99E+06 | 12% | 224% | 3 |
| V158D/Q286R/E296V/M298Q/H373F | V21D/Q143R/E154V/M156Q/H224F | 2.39E+08 | 3.82E+07 | 16% | 638% | 5 |
| M298Q/Q366N/H373F† | M156Q/Q217N/H224F† | 7.05E+07 | 1.78E+07 | 25% | 188% | 3 |
| T239V/M298Q/H373F† | T99V/M156Q/H224F† | 4.43E+07 | 1.10E+07 | 25% | 118% | 3 |
| T239I/M298Q/H373F† | T99I/M156Q/H224F† | 3.47E+07 | 4.57E+06 | 13% | 92% | 3 |
| T128N/P129A/Q286R/M298Q/Q366N/H373F† | T[128]N/P[129]A/Q143R/M156Q/Q217N/H224F† | 1.33E+08 | 1.81E+07 | 14% | 355% | 2 |
| T239V/Q286R/M298Q/Q366N† | T99V/Q143R/M156Q/Q217N† | 1.85E+08 | 5.96E+07 | 32% | 491% | 4 |
| T239I/Q286R/M298Q/Q366N† | T99I/Q143R/M156Q/Q217N† | 7.40E+07 | 1.40E+07 | 19% | 197% | 4 |
| TF-independent assay | | | | | | |
| WT (NovoSeven ®) | WT (NovoSeven ®) | 9.8 | 3.0 | 30% | 88% | 14 |
| WT (NovoSeven-RT ®) | WT (NovoSeven-RT ®) | 12.4 | 4.3 | 35% | 112% | 12 |
| WT | WT | 11.1 | 2.7 | 25% | 100% | 5 |
| WT† | WT† | 6.9 | 2.2 | 31% | 100% | 7 |
| T128N/P129A | T[128]N/P[129]A | 17.0 | 5.2 | 31% | 153% | 3 |
| Gla swap FIX | Gla swap FIX | 41.3 | 3.0 | 7% | 373% | 2 |
| A122N/G124S | A[122]N/G[124]S | 3.4 | 0.6 | 16% | 31% | 2 |
| S52A/S60A | S[52]A/S[60]A | 3.8 | | | 34% | 1 |
| M298Q† | M156Q† | 69.9 | 49.4 | 71% | 1013% | 3 |
| T128N/P129A/M156Q† | T[128]N/P[129]A/M156Q† | 90.8 | 70.8 | 78% | 1316% | 5 |
| V158D/E296V/M298Q | V21D/E154V/M156Q | 1221.7 | 307.0 | 25% | 11025% | 4 |
| V158D/E296V/M298Q† | V21D/E154V/M156Q† | 984.5 | 308.4 | 31% | 14265% | 2 |
| T128N/P129A/V158D/E296V/M298Q | T[128]N/P[129]A/V21D/E154V/M156Q | 1375.8 | 140.3 | 10% | 12415% | 3 |
| S52A/S60A/V158D/E296V/M1298Q | S[52]A/S[60]A/V21D/E154V/M156Q | 1760.1 | 575.0 | 33% | 15883% | 3 |
| Q286R | Q143R | 10.3 | 0.7 | 7% | 93% | 3 |
| T128N/P129A/Q286R | T[128]N/P[129]A/Q143R | 8.7 | 4.3 | 50% | 78% | 5 |
| T128N/P129A/Q286R† | T[128]N/P[129]A/Q143R† | 10.5 | 5.6 | 53% | 152% | 6 |
| S52A/S60A/S82A | S[52]A/S[60]A/S82A | 10.2 | 4.7 | 47% | 92% | 3 |
| T128N/P129A/S222A | T[128]N/P[129]A/S82A | 4.8 | | | 43% | 1 |
| S52A/S60A/S222A | S[52]A/S[60]A/S82A | 19.6 | | | 177% | 1 |
| H257S | H117S | 3.1 | 1.1 | 35% | 28% | 7 |
| Q366V | Q217V | 4.3 | 0.6 | 14% | 39% | 2 |
| Gla swapFIX/Q366V | Gla swapFIX/Q217V | 90.0 | 17.7 | 20% | 812% | 2 |
| Q286R/H257A | Q143R/H117A | 4.3 | 2.1 | 49% | 39% | 3 |
| Q286R/H257A† | Q143R/H117A† | 2.5 | 0.0 | 0% | 36% | 2 |
| Gla swap FIX/T128N/P129A/S222A/Q286R | Gla swap FIX/T[128]N/P[129]A/S82A/Q143R | 15.5 | 2.9 | 18% | 140% | 4 |
| Gla swap FIX/T128N/P129A/S222A/Q286R† | Gla swap FIX/T[128]N/P[129]A/S82A/Q143R† | 21.3 | 6.5 | 31% | 309% | 5 |
| Gla swap FIX/S52A/S60A/S222A/Q286R | S[52]A/S[60]A/S82A/Q143R | 2.9 | | | 26% | 1 |
| Q286R/S222A/H257A | Q143R/S82A/H117A | 21.3 | 6.5 | 31% | 193% | 5 |
| Q286R/M298Q | Q143R/M156Q | 79.9 | 18.9 | 24% | 721% | 5 |
| Q286R/M298Q† | Q143R/M156Q† | 162.4 | 79.9 | 49% | 2353% | 12 |
| Q286R/M298Q§ | Q143R/M156Q§ | 135.1 | 7.3 | 5% | 1957% | 2 |
| Gla swap FIX/Q286R/M298Q | Gla swap FIX/Q143R/M156Q | 672.7 | 79.1 | 12% | 6070% | 4 |
| Gla swap FIX/Q286R/M298Q† | Gla swap FIX/Q143R/M156Q† | 678.2 | 249.0 | 37% | 9826% | 11 |
| T128N/P129A/Q286R/M298Q | T[128]N/P[129]A/Q143R/M156Q | 81.6 | 13.4 | 16% | 736% | 4 |
| T128N/P129A/Q286R/M298Q† | T[128]N/P[129]A/Q143R/M156Q† | 212.5 | 135.4 | 64% | 3079% | 10 |

TABLE 15-continued

Catalytic activity of FVIIa variants

| Mutation (mature FVII numbering) | Mutation (Chymotrypsin numbering) | $k_{cat}/K_M$ (M$^{-1}$s$^{-1}$) | SD | % CV | $k_{cat}/K_M$ (% WT) | n |
|---|---|---|---|---|---|---|
| Gla swap FIX/T128N/P129A/Q286R/M298Q | Gla swap FIX/T[128]N/P[129]A/Q143R/M156Q | 83.8 | 35.3 | 42% | 756% | 6 |
| Gla swap FIX/T128N/P129A/Q286R/M298Q† | Gla swap FIX/T[128]N/P[129]A/Q143R/M156Q† | 751.9 | 305.3 | 41% | 10895% | 6 |
| {Gla swap FIX/E40L}/Q286R/M298Q | {Gla swap FIX/E[40]L}/Q143R/M156Q | 814.1 | 89.0 | 11% | 7346% | 2 |
| {Gla swap FIX/K43I}/Q286R/M298Q | {Gla swap FIX/K[43]I}/Q143R/M156Q | 902.4 | 360.6 | 40% | 8144% | 11 |
| {Gla swap FIX/K43I}/Q286R/M298Q† | {Gla swap FIX/K[43]I}/Q143R/M156Q† | 794.2 | 178.7 | 23% | 11508% | 6 |
| {Gla swap FIX/Q44S}/Q286R/M298Q | {Gla swap FIX/Q[44]S}/Q143R/M156Q | 729.0 | 4.5 | 1% | 6578% | 2 |
| {Gla swap FIX/M19K}/Q286R/M298Q | {Gla swap FIX/M[19]K}/Q143R/M156Q | 512.0 | 51.4 | 10% | 4620% | 2 |
| S52A/S60A/Q286R/M298Q | S[52]A/S[60]A/Q143R/M156Q | 216.8 | 1.6 | 1% | 1956% | 2 |
| Gla swap FIX/S52A/S60A/Q286R/M298Q | Gla swap FIX/S[52]A/S[60]A/Q143R/M156Q | 988.7 | 207.5 | 21% | 14327% | 2 |
| {Gla swap FIX/K43I}/T128N/P129A/Q286R/M298Q† | {Gla swap FIX/K[43]I}/T[128]N/P[129]A/Q143R/M156Q† | 389.4 | 34.3 | 9% | 5642% | 2 |
| S222A/H257A/Q286R/M298Q | S82A/H117A/Q143R/M156Q | 345.3 | 99.9 | 29% | 3116% | 3 |
| T128N/P129A/S222A/H257A/Q286R/M298Q | T[128]N/P[129]A/S82A/H117A/Q143R/M156Q | 24.8 | 17.2 | 69% | 224% | 4 |
| T128N/P129A/S222A/H257A/Q286R/M298Q† | T[128]N/P[129]A/S82A/H117A/Q143R/M156Q† | 82.6 | 40.2 | 49% | 1196% | 3 |
| S52A/S60A/S222A/H257A/Q286R/M298Q | S[52]A/S[60]A/S82A/H117A/Q143R/M156Q | 115.6 | 62.9 | 54% | 1043% | 2 |
| H257S/Q286R/Q366V | H117S/Q143R/Q217V | 7.7 | 1.8 | 23% | 69% | 2 |
| S222A/H257A/Q286R/Q366V | S82A/H117A/Q143R/Q217V | 12.5 | 2.8 | 23% | 113% | 2 |
| Q286R/M298Q/Q366N | Q143R/M156Q/Q217N | 65.9 | 33.4 | 51% | 595% | 5 |
| T129N/P129A/Q286R/M298Q/Q366N† | T[129]N/P[129]A/Q143R/M156Q/Q217N† | 64.6 | 28.7 | 44% | 936% | 4 |
| {Gla swap FIX/K43I}/Q286R/M298Q/Q217N† | {Gla swap FIX/K[43]I}/Q143R/M156Q/Q217N† | 84.9 | 76.5 | 90% | 1230% | 4 |
| {Gla swap FIX/K43I}/T128N/P129A/Q286R/M298Q/Q366N† | {Gla swap FIX/K[43]I}/T[128]N/P[129]A/Q143R/M156Q/Q217N† | 218.5 | 137.8 | 63% | 3166% | 3 |
| Q286R/H373F | Q143R/H224F | 81.6 | 123.7 | 152% | 736% | 9 |
| T128N/P129A/Q286R/H373F | T[128]N/P[129]A/Q143R/H224F | 6.6 | 0.9 | 13% | 59% | 2 |
| S52A/S60A/Q286R/H373F | S[52]A/S[60]A/Q143R/H224F | 30.1 | | | 272% | 1 |
| Q286R/M298Q/H373F | Q143R/M156Q/H224F | 114.8 | 24.7 | 22% | 1036% | 5 |
| T128N/P129A/Q286R/M298Q/H373F† | T[128]N/P[129]A/Q143R/M156Q/H224F† | 30.7 | 8.9 | 29% | 277% | 4 |
| S52A/S60A/Q286R/M298Q/H373F | S[52]A/S[60]A/Q143R/M156Q/H224F | 63.3 | 10.8 | 17% | 571% | 3 |
| M298Q/H373F | M156Q/H224F | 96.4 | 47.0 | 49% | 870% | 5 |
| T128N/P129A/M298Q/H373F | T[128]N/P[129]A/M156Q/H224F | 91.6 | 48.0 | 52% | 1327% | 3 |
| V158D/Q286R/E296V/M298Q | V21D/Q143R/E154V/M156Q | 1023.9 | 339.3 | 33% | 9240% | 5 |
| S222A/T239V | S82A/T99V | 3.0 | | | 27% | 1 |
| Gla swap FIX/S222A/T239V/Q286R | Gla swap FIX/S82A/T99V/Q143R | 17.4 | 2.2 | 13% | 157% | 3 |
| Gla swap FIX/S222A/T239V/Q286R† | Gla swap FIX/S82A/T99V/Q143R† | 87.9 | 61.7 | 70% | 1274% | 4 |
| T239V/Q286R/M298Q | T99V/Q143R/M156Q | 29.3 | 6.2 | 21% | 264% | 4 |
| Gla swap FIX/T239V/Q286R/M298Q | Gla swap FIX/T99V/Q143R/M156Q | 277.7 | 64.2 | 23% | 2506% | 3 |
| Gla swap FIX/T239V/Q286R/M298Q† | Gla swap FIX/T99V/Q143R/M156Q† | 902.4 | 323.5 | 36% | 13076% | 6 |
| T128N/P129A/T239V/Q286R/M298Q† | T[128]N/P[129]A/T99V/Q143R/M156Q† | 229.7 | 134.1 | 58% | 3329% | 5 |
| S222A/T239V/H257A/Q286R/M298Q | S82A/T99V/H117A/Q143R/M156Q | 143.0 | 93.1 | 65% | 1290% | 10 |
| T128N/P129A/S222A/T239V/H257A/Q286R/M298Q | T[128]N/P[129]A/S82A/T99V/H117A/Q143R/M156Q | 179.0 | 80.5 | 45% | 2593% | 5 |
| T239V/Q286R/H373F | T99V/Q143R/H224F | 12.2 | | | 110% | 1 |
| T239V/Q286R/M298Q/H373F | T99V/Q143R/M156Q/H224F | 40.7 | 5.2 | 13% | 367% | 2 |
| T128N/P129A/T99V/Q143R/M156Q/H224F | T[128N]/P129A/T99V/Q143R/M156Q/H224F | 290.0 | 72.9 | 25% | 4203% | 4 |
| V158D/T239I/E296V/M298Q | V21D/T99I/E154V/M156Q | 216.3 | 32.5 | 15% | 1951% | 2 |

TABLE 15-continued

Catalytic activity of FVIIa variants

| Mutation (mature FVII numbering) | Mutation (Chymotrypsin numbering) | $k_{cat}/K_M$ $(M^{-1}s^{-1})$ | SD | % CV | $k_{cat}/K_M$ (% WT) | n |
|---|---|---|---|---|---|---|
| T239I/Q286R | T99I/Q143R | 4.6 | 1.3 | 28% | 41% | 4 |
| S222A/T239I | S82A/T99I | 1.7 | | | 15% | 1 |
| Gla swap FIX/ S222A/T239I/Q286R | Gla swap FIX/ S82A/T99I/Q143R | 20.3 | | | 184% | 1 |
| T239I/Q286R/M298Q | T99I/Q143R/M156Q | 11.3 | 4.0 | 35% | 102% | 4 |
| Gla swap FIX/ T239I/Q286R/M298Q | Gla swap FIX/ T99I/Q143R/M156Q | 244.0 | 9.6 | 4% | 2202% | 2 |
| T128N/P129A/T239I/Q286R/ M298Q | T[128N]/P[129]A/T99I/Q143R/ M156Q | 77.8 | 40.3 | 52% | 1128% | 5 |
| S222A/T239I/H257A/Q286R/ M298Q | S82A/T99I/H117A/Q143R/M156Q | 51.6 | 5.7 | 11% | 466% | 2 |
| V158D/T239V/E296V/M298Q | V21D/T99V/E154V/M156Q | 1864.3 | 374.0 | 20% | 16823% | 2 |
| V158D/T239V/E296V/M298Q† | V21D/T99V/E154V/M156Q† | 4231.6 | 913.4 | 22% | 61315% | 4 |
| T239V/Q286R | T99V/Q143R | 11.8 | 4.1 | 35% | 106% | 4 |
| T239I/Q286R/M298Q/H373F | T99I/Q143R/M156Q/H224F | 13.1 | 3.8 | 29% | 118% | 3 |
| T128N/P129A/T239I/Q286R/ M298Q/H373F† | T[128]N/P[129]A/T99I/Q143R M156Q/H224F† | 113.3 | 43.7 | 39% | 1642% | 5 |
| H257S/Q286R/M298Q | H117S/Q143R/M156Q | 27.4 | 4.1 | 15% | 247% | 4 |
| Gla swap FIX/ S8222A/H257S/Q143R | Gla swap FIX/ S82A/H117S/Q143R | 20.5 | 3.6 | 18% | 185% | 2 |
| S222A/Q286R/M298Q/ H373F | S82A/Q143R/M156Q/H224F | 41.7 | 9.1 | 22% | 376% | 4 |
| H257S/Q286R/M298Q/H373F | H117S/Q143R/M156Q/H224F | 30.4 | 9.1 | 30% | 274% | 3 |
| S82A/Q143R/M156Q/H224F | S82A/Q143R/M156Q/H224F | 430.2 | 126.8 | 29% | 3883% | 3 |
| Gla swap FIX/S222A/ Q286R/M298Q/H373F | Gla swap FIX/ S82A/Q143R/M156Q/H224F | 192.1 | 36.8 | 19% | 1733% | 2 |
| S222A/Q286R/M298Q | S82A/Q143R/M156Q | 252.9 | 7.4 | 3% | 2282% | 2 |
| Gla swap FIX/ S222A/Q286R/M298Q | Gla swap FIX/ S82A/Q143R/M156Q | 414.7 | 81.3 | 20% | 3742% | 2 |
| T128N/P129A/A175S/ Q366V | T[128]N/P[129]A/A39S/Q217V | 3.4 | 1.0 | 29% | 30% | 2 |
| A122N/G124S/A175S/ Q366V | A[122]N/G[124]S/A39S/Q217V | 3.0 | 0.8 | 26% | 27% | 4 |
| T128N/P129A/A175S/ S222A | T[128]N/P[129]A/A39S/S82A | 1.9 | 0.5 | 26% | 17% | 2 |
| T128N/P129A/A175S/ Q286R | T[128]N/P[129]A/A39S/Q143R | 3.3 | 1.2 | 37% | 29% | 4 |
| A122N/G124S/A175S/ Q286R | A[122]N/G[124]S/A39S/Q143R | 3.0 | 0.7 | 23% | 27% | 2 |
| Gla swap FIX/ S222A/Q286R/H373F | Gla swap FIX/ S82A/Q143R/H224F | 81.2 | 66.7 | 82% | 732% | 2 |
| V158D/E296V/M298Q/H373F | V21D/E154V/M156Q/H224F | 1297.2 | 486.1 | 37% | 11706% | 4 |
| H257A/Q286R/M298Q | H117A/Q143R/M156Q | 61.5 | 43.8 | 71% | 555% | 2 |
| Gla swap FIX/ T128N/P129A/A175S/S222A/ Q286R | Gla swap FIX/ T[128]N/P[129]A/A39S/S82A/ Q143R | 30.5 | | | 276% | 1 |
| T128N/P129A/A175S/ S222A/H257A/Q286R/M298Q | T[128]N/P[129]A/A39S/S82A/ H117A/Q143R/M156Q | 20.3 | 3.8 | 19% | 183% | 2 |
| V158D/Q286R/E296V/M298Q/ H373F | V21D/Q143R/E154V/M156Q/ H224F | 573.6 | 100.4 | 18% | 5176% | 6 |
| M298Q/Q366N/H373F† | M156Q/Q217N/H224F† | 125.9 | 75.2 | 60% | 1825% | 4 |
| T239V/M298Q/H373F† | T99V/M156Q/H224F† | 319.5 | 125.0 | 39% | 4629% | 6 |
| T239I/M298Q/H373F† | T99I/M156Q/H224F† | 138.2 | 101.9 | 74% | 2003% | 7 |
| T128N/P129A/Q286R/M298Q/ Q366N/H373F† | T[128]N/P[129]A/Q143R/M156Q/ Q217N/H224F† | 160.9 | 43.3 | 27% | 2331% | 4 |
| T239V/Q286R/M298Q/Q366N† | T99V/Q143R/M156Q/Q2176N† | 64.2 | 36.3 | 57% | 931% | 3 |
| T2391/Q286R/M298Q/Q366N† | T99I/Q143R/M156Q/Q217N† | 88.8 | 23.5 | 26% | 1287% | 5 |

†produced in CHOX cells
§produced in CHOX stable cell line clone 52-5F7

Example 5

Determination of the Inhibition of FVIIa/TF or FVIIa by AT-III/Heparin

The potency of the interaction between the AT-III/heparin complex and FVIIa in the presence or absence of soluble tissue factor (sTF), i.e. TF-dependent or TF-independent, was assessed by measuring the level of inhibition of various concentrations of AT-III on the catalytic activity of FVIIa/sTF towards a substrate, Mesyl-FPR-ACC. The $K_{0.5}$ value was determined for each FVIIa variant tested, which corresponds to the molar concentration of AT-III that was required for 50% inhibition ($IC_{50}$) of FVIIa variant in a 30 minute assay at room temperature (~250).

Two separate assays were prepared, one with sTF and one without sTF. A 2 µM solution of AT-III/heparin (final 5 µM heparin) was prepared by mixing 26.4 µL of 151.7 µM AT-III (plasma purified human AT-III; Molecular Innovations) with 50 µL of 0.2 mM LMW heparin (CalBiochem), 400 µL of 5× assay buffer (100 mM Hepes, 750 mM NaCl, 25 mM $CaCl_2$, 0.05% BSA, 0.5% PEG 8000, pH 7.4) and 1.523 mL of reagent grade water. This solution was for use as the highest concentration in the TF-dependent assay. A solution containing 4 μM AT-III/heparin (final 5 μM heparin) was prepared for use in the TF-independent assay by mixing 52.8 μL of 151.7 μM AT-III (Molecular Innovations) with 50 μL of 0.2 mM LMW heparin (CalBiochem), 400 μL of 5× assay buffer and 1.497 mL of reagent grade water. The AT-III/heparin solutions were incubated for 5-10 minutes at room temperature and then diluted two-fold down in a 96 deep-well polypropylene plate with a final volume of 1 mL containing 5 μM heparin, resulting in dilutions of 2000, 1000, 500, 250, 125, 62.5, 31.25 and 0 nM, or 4000, 2000, 1000, 500, 250, 125, 62.5, and 0 nM. The FVIIa variants and wild-type FVIIa were diluted to 250 nM in 1× assay buffer (20 mM Hepes, 150 mM NaCl, 5 mM $CaCl_2$, 0.01% BSA, 0.1% PEG 8000, pH 7.4). For the TF-dependent assay, 5 nM FVIIa/50 nM sTF complexes were formed by mixing 20 μL of FVIIa with 10 μL of 5 μM sTF (R&D Systems Human Coagulation Factor III: #2339-PA), 200 μL 5× assay buffer and 770 μL reagent grade water and incubating the solutions for 10-15 minutes at room temperature. For the TF-independent assay, 100 μL of FVIIa was mixed with 200 μL 5× assay buffer and 700 μL reagent grade water to produce 25 nM solutions of FVIIa. To start the assay, 25 μL of the FVIIa/TF or FVIIa alone solutions were separately mixed with 25 μL of each dilution of AT-III/heparin in wells of a 96-well black half area assay plate (Nunc). The final assay conditions for the TF-dependent assay were 2.5 nM FVIIa/25 nM sTF and AT-III/heparin concentrations ranging from 1000 nM to 0 nM. For the TF-independent assay, FVIIa concentrations were 12.5 nM FVIIa and AT-III/heparin concentrations ranged from 2000 nM to 0 nM. The plates were incubated for 30 minutes with shaking at room temperature (~25° C.).

A stock solution of FVIIa substrate (Mesyl-FPR-ACC) was prepared by dissolving the substrate in DMSO to 20 mM then preparing a working solution of 0.5 mM in 1× assay buffer. Following incubation of the assay plate from above, 50 μl of the FVIIa substrate was added to each well of the assay plate. The reactions were mixed and the residual activity of FVIIa was assessed by following the initial rates of substrate cleavage for 15 minutes in a fluorescence reader set to 30° C.

To determine the degree of inhibition by AT-III/heparin for FVIIa or FVIIa variants, raw data collected with the SoftMax Pro application (Molecular Devices) were exported as .XML files. Further non-linear data analyses were performed with XLfit4, a software package for automated curve fitting and statistical analysis within the Microsoft Excel spreadsheet environment (IDBS Software). The spreadsheet template was used to calculate the AT-III dilution series, ratio of AT-III to FVIIa, and the Vi/Vo ratios for each FVIIa replicate at each experimental AT-III concentration. Non-linear regression analyses of residual FVIIa activity (expressed as Vi/Vo) versus AT-III concentration was processed using XLfit4 and a hyperbolic inhibition equation of the form $((C+(Amp*(1-(X/(K_{0.5}+X))))$; where C=the offset (fixed at 0 to permit extrapolation of data sets that do not reach 100% inhibition during the course of the assay), Amp=the amplitude of the fit and $K_{0.5}$, which corresponds to the concentration of AT-III required for half-maximal inhibition under the assay conditions. For several FVIIa variants, AT-III inhibited less than 20-25% of the of the total protease activity at the highest tested concentration of AT-III, representing an upper limit of detection for the assay. Variants with less than 20-25% maximal inhibition were therefore assigned a lower limit $K_{0.5}$ value (5 μM for TF-dependent and 10 μM for TF-independent) and in most cases are expected to have AT-III resistances greater than the reported value.

Tables 16 and 17 provide the results of the assays that were performed using FVIIa variants expressed in Freestyle TM 293-F cells and/or BHK-21 cells, in the presence and absence of TF, respectively. The results are presented both as the fitted K0.5 parameter and as a representation of the extent of AT-III resistance for each variant compared to the wild-type FVIIa expressed as a ratio of their fitted $K_{0.5}$ values ($K_{0.5}$ variant/$K_{0.5}$ wild-type). Several FVIIa variants exhibited increased resistance to AT-III compared to wild-type FVIIa. For example, Q286R-FVIIa (i.e. FVIIa containing the Q286R mutation), Q286R/S222A-FVIIa, Q286R/S222A/Gla Swap FIX-FVIIa, A175S/Q286R/Q366V-FVIIa, Q286M-FVIIa, Q286L-FVIIa and Q286Y-FVIIa are among the group which exhibited resistance to AT-III in the absence of TF that was over 4 times greater than that of wild-type FVIIa.

TABLE 16

Inhibition of FVIIa variants by AT-III/heparin in the presence of TF

| Mutation (mature FVII numbering) | Mutation (Chymotrypsin Numbering) | TE-Dependent ATIII Resistance Assay | | | |
|---|---|---|---|---|---|
| | | 293-F Cells | | BHK-21 Cells | |
| | | $K_{0.5}$ (nM) | $K_{0.5\,mut}/K_{0.5\,wt}$ | $K_{0.5}$ (nM) | $K_{0.5\,mut}/K_{0.5\,wt}$ |
| WT | WT | 72.3 | 1.0 | 56.0 | 1.0 |
| V158D/E296V/M298Q | V21D/E154V/M156Q | 75.1 | 1.0 | 79.0 | 1.4 |
| Q286R | Q143R | 60.6 | 0.8 | 59.1 | 1.1 |
| S222A | S82A | 47.6 | 0.7 | 43.9 | 0.8 |
| H257S | H117S | 50.6 | 0.7 | 52.9 | 0.9 |
| H373D | H224D | 423.6 | 5.9 | | |
| H373E | H224E | 152.1 | 2.1 | | |
| H373S | H224S | 64.2 | 0.9 | | |
| H373F | H224F | 38.7 | 0.5 | | |
| H373A | H224A | 76.9 | 1.1 | | |
| Q366D | Q217D | 2239.2 | 31.0 | | |
| Q366E | Q217E | 116.2 | 1.6 | | |
| Q366N | Q217N | 75.3 | 1.0 | | |
| Q366T | Q217T | 57.5 | 0.8 | | |
| Q366S | Q217S | 107.2 | 1.5 | | |
| Q366V | Q217V | 25.8 | 0.4 | 20.0 | 0.4 |
| A175S | A39S | 112.4 | 1.6 | | |
| A122N/G124S | A[122]N/G[124]S | 48.2 | 0.7 | | |
| Q286R/S222A | Q143R/S82A | | | 53.3 | 1.0 |
| Q286R/S222A/Gla Swap FIX | Q143R/S82A/Gla swap FIX | 83.7 | 1.2 | | |

TABLE 16-continued

Inhibition of FVIIa variants by AT-III/heparin in the presence of TF

| Mutation (mature FVII numbering) | Mutation (Chymotrypsin Numbering) | TE-Dependent ATIII Resistance Assay | | | |
|---|---|---|---|---|---|
| | | 293-F Cells | | BHK-21 Cells | |
| | | $K_{0.5}$ (nM) | $K_{0.5\,mut}/K_{0.5\,wt}$ | $K_{0.5}$ (nM) | $K_{0.5\,mut}/K_{0.5\,wt}$ |
| Q286R/M298Q | Q143R/M156Q | | | 74.2 | 1.3 |
| Q286R/M298Q/K341Q | Q143R/M156Q/K192Q | | | 21.8 | 0.4 |
| Q286R/M298Q/K199E | Q143R/M156Q/K60cE | | | 101.1 | 1.8 |
| P321K | P170iK | | | 97.5 | 1.7 |
| P321E | P170iE | | | 66.0 | 1.2 |
| P321Y | P170iY | | | 49.5 | 0.9 |
| P321S | P170iS | | | 60.7 | 1.1 |
| T239S | T99S | 254.6 | 3.5 | | |
| T239Q | T99Q | | | 117.2 | 2.1 |
| T239V | T99V | | | 42.5 | 0.8 |
| T239L | T99L | | | 81.1 | 1.4 |
| T239H | T99H | | | 52.0 | 0.9 |
| T239I | T99I | | | 125.3 | 2.2 |
| H257A/M298Q | H117A/M156Q | | | 89.1 | 1.6 |
| S222A/H257A/Q286R/M298Q | S82A/H117A/Q143R/M156Q | 66.6 | 0.9 | | |
| Q286R/Q366V | Q143R/Q217V | | | 62.0 | 1.1 |
| A175S/Q286R/Q366V | A39S/Q143R/Q217V | | | 72.0 | 1.3 |
| S222A/Q286R/Q366V | S82A/Q143R/Q217V | | | 38.5 | 0.7 |
| Q286M | Q143M | 53.1 | 0.7 | | |
| Q286L | Q143L | 114.4 | 1.6 | | |
| Q286Y | Q143Y | 131.3 | 1.8 | | |
| Q366I | Q217I | 23.2 | 0.3 | | |
| Q366L | Q217L | 23.0 | 0.3 | | |
| Q366M | Q217M | 35.4 | 0.5 | | |

TABLE 17

Inhibition of FVIIa variants by AT-III/heparin in the absence of TF

| Mutation (mature FVII numbering) | Mutation (Chymotrypsin Numbering) | TF-Independent ATIII Resistance Assay | | | |
|---|---|---|---|---|---|
| | | 293-F Cells | | BHK-21 Cells | |
| | | $K_{0.5}$ (nM) | $K_{0.5\,mut}/K_{0.5\,wt}$ | $K_{0.5}$ (nM) | $K_{0.5\,mut}/K_{0.5\,wt}$ |
| WT | WT | 2265 | 1.0 | 2222 | 1.0 |
| V158D/E296V/M298Q | V21D/E154V/M156Q | 389 | 0.2 | 415 | 0.2 |
| Q286R | Q143R | 10000 | >4.4 | 10000 | >4.5 |
| S222A | S82A | 2338 | 1.0 | 2088 | 0.9 |
| H257S | H117S | 5884 | 2.6 | 5584 | 2.5 |
| H373D | H224D | 10000 | >4.4 | | |
| H373E | H224E | 6949 | 3.1 | | |
| H373S | H224S | 9513 | 4.2 | | |
| H373F | H224F | 1306 | 0.6 | | |
| H373A | H224A | 10000 | >4.4 | | |
| Q366D | Q217D | 10000 | >4.4 | | |
| Q366E | Q217E | 6901 | 3.0 | | |
| Q366N | Q217N | 5186 | 2.3 | | |
| Q366T | Q217T | 5885 | 2.6 | | |
| Q366S | Q217S | 10000 | >4.4 | | |
| Q366V | Q217V | 487 | 0.2 | 531 | 0.2 |
| A175S | A39S | 5785 | 2.6 | | |
| A122N/G124S | A[122]N/G[124]S | 2926 | 1.3 | | |
| Q286R/S222A | Q143R/S82A | | | 10000 | >4.5 |
| Q286R/S222A/Gla Swap FIX | Q143R/S82A/Gla swap FIX | 10000 | >4.4 | | |
| Q286R/M298Q | Q143R/M156Q | | | 3663 | 1.6 |
| Q286R/M298Q/K341Q | Q143R/M156Q/K192Q | | | 72 | |
| Q286R/M298Q/K199E | Q143R/M156Q/K60cE | | | 5182 | 2.3 |
| P321K | P170iK | | | 5274 | 2.4 |
| P321E | P170iE | | | 3666 | 1.6 |
| P321Y | P170iY | | | 705 | 0.3 |
| P321S | P170iS | | | 2689 | 1.2 |
| T239S | T99S | 10000 | >4.4 | | |
| T239Q | T99Q | | | 2222 | 1.0 |
| T239V | T99V | | | 2644 | 1.2 |
| T239L | T99L | | | 8532 | 3.8 |

TABLE 17-continued

Inhibition of FVIIa variants by AT-III/heparin in the absence of TF

| Mutation (mature FVII numbering) | Mutation (Chymotrypsin Numbering) | TF-Independent ATIII Resistance Assay | | | |
|---|---|---|---|---|---|
| | | 293-F Cells | | BHK-21 Cells | |
| | | $K_{0.5}$ (nM) | $K_{0.5\,mut}/K_{0.5\,wt}$ | $K_{0.5}$ (nM) | $K_{0.5\,mut}/K_{0.5\,wt}$ |
| T239H | T99H | | | 10000 | >4.5 |
| T239I | T99I | | | 10000 | >4.5 |
| H257A/M298Q | H117A/M156Q | | | 1344 | 0.6 |
| S222A/H257A/Q286R/M298Q | S82A/H117A/Q143R/M156Q | 7742 | 3.4 | | |
| Q286R/Q366V | Q143R/Q217V | | | 2251

TABLE 18-continued

Inhibition of FVIIa variants by AT-III/heparin in the absence of TF

| Mutation (mature FVII numbering) | Mutation (Chymotrypsin Numbering) | K₀.₅ (nM) | SD | % CV | K₀.₅ mut/K₀.₅ wt | n |
|---|---|---|---|---|---|---|
| Q286R/H257A† | Q143R/H117A† | 2800.8 | 938.4 | 34% | 5.57 | 5 |
| Q286R/S222A | Q143R/S82A | 1203.0 | 191.2 | 16% | 3.05 | 2 |
| Gla swap FIX/T128N/P129A/S222A/Q286R | Gla swap FIX/T[128]N/P[129]A/S82A/Q143R | 1703.2 | 145.2 | 9% | 4.32 | 2 |
| Q286R/S222A/H257A | Q143R/S82A/H117A | 2592.0 | 806.5 | 31% | 6.58 | 4 |
| Q286R/M298Q | Q143R/M156Q | 299.3 | 62.9 | 21% | 0.76 | 7 |
| Q286R/M298Q† | Q143R/M156Q† | 287.3 | 26.6 | 9% | 0.57 | 20 |
| Q286R/M298Q§ | Q143R/M156Q§ | 395.1 | 56.4 | 14% | 0.79 | 3 |
| Gla swap FIX/Q286R/M298Q | Gla swap FIX/Q143R/M156Q | 281.6 | 43.2 | 15% | 0.72 | 3 |
| Gla swap FIX/Q286R/M298Q† | Gla swap FIX/Q143R/M156Q† | 238.2 | 21.6 | 9% | 0.47 | 3 |
| T128N/P129A/Q286R/M298Q | T[128]N/P[129]A/Q143R/M156Q | 283.7 | 49.4 | 17% | 0.72 | 13 |
| T128N/P129A/Q286R/M298Q† | T[128]N/P[129]A/Q143R/M156Q† | 283.7 | 77.6 | 27% | 0.56 | 3 |
| Gla swap FIX/T128N/P129A/Q286R/M298Q | Gla swap FIX/T[128]N/P[129]A/Q143R/M156Q | 508.2 | 197.0 | 39% | 1.29 | 3 |
| Gla swap FIX/T128N/P129A/Q286R/M298Q† | Gla swap FIX/T[128]N/P[129]A/Q143R/M156Q† | 325.2 | 82.2 | 25% | 0.65 | 2 |
| {Gla swap FIX/E40L}/Q286R/M298Q | {Gla swap FIX/E[40]L}/Q143R/M156Q | 286.7 | 2.4 | 1% | 0.73 | 2 |
| {Gla swap FIX/K43I}/Q286R/M298Q | {Gla swap FIX/K[43]I}/Q143R/M156Q | 244.3 | 29.8 | 12% | 0.62 | 5 |
| {Gla swap FIX/K43I}/Q286R/M298Q† | {Gla swap FIX/K[43]I}/Q143R/M156Q† | 219.3 | 13.7 | 6% | 0.44 | 2 |
| {Gla swap FIX/Q44S}/Q286R/M298Q | {Gla swap FIX/Q[44]S}/Q143R/M156Q | 271.4 | 12.4 | 5% | 0.69 | 2 |
| {Gla swap FIX/M19K}/Q286R/M298Q | {Gla swap FIX/M[19]K}/Q143R/M156Q | 309.6 | | | 0.79 | 1 |
| Gla swap FIX/S52A/S60A/Q286R/M298Q† | Gla swap FIX/S[52]A/S[60]A/Q143R/M156Q† | 253.6 | | | 0.50 | 1 |
| {Gla swap FIX/M19K/E40L/K43I/Q44S}/Q286R/M298Q | {Gla swap FIX/M[19]K/E[40]L/K[43]I/Q[44]S}/Q143R/M156Q | 339.3 | 100.8 | 30% | 0.86 | 2 |
| {Gla swap FIX/K43I}/T128N/P129A/Q286R/M298Q† | {Gla swap FIX/K[43]I}/T[128]N/P[129]A/Q143R/M156Q† | 222.5 | 10.7 | 5% | 0.44 | 2 |
| S222A/H257A/Q286R/M298Q | S82A/H117A/Q143R/M156Q | 313.9 | | | 0.80 | 1 |
| T128N/P129A/S222A/H257A/Q286R/M298Q | T[128]N/P[129]A/S82A/H117A/Q143R/M156Q | 653.0 | 127.9 | 20% | 1.66 | 4 |
| T128N/P129A/S222A/H257A/Q286R/M298Q† | T[128]N/P[129]A/S82A/H117A/Q143R/M156Q† | 327.7 | 23.2 | 7% | 0.65 | 2 |
| S52A/S60A/S222A/H257A/Q286R/M298Q | S[52]A/S[60]A/S82A/H117A/Q143R/M156Q | 447.6 | 117.6 | 26% | 1.14 | 3 |
| Q286R/M298Q/Q366N | Q143R/M156Q/Q217N | 324.1 | 77.9 | 24% | 0.82 | 3 |
| T128N/P129A/Q286R/M298Q/Q366N† | T[129]N/P[129]A/Q143R/M156Q/Q217N† | 345.8 | 24.2 | 7% | 0.69 | 3 |
| {Gla swap FIX/K43I}/Q286R/M298Q/Q366N† | {Gla swap FIX/K[43]I}/Q143R/M156/Q217N† | 404.4 | 48.0 | 12% | 0.80 | 3 |
| {Gla swap FIX/K43I}/T[128]N/P[129]A/Q286R/M298Q/Q366N† | {Gla swap FIX/K[43]I}/T[128]N/P[129]A/Q143R/M156Q/Q217N† | 319.1 | 71.8 | 22% | 0.63 | 2 |
| Q286R/H373F | Q143R/H224F | 620.8 | 133.4 | 3% | 1.58 | 2 |
| T128N/P129A/Q286R/H373F | T[128]N/P[129]A/Q143R/H224F | 590.4 | 104.2 | 18% | 1.50 | 4 |
| Q286R/M298Q/H373F | Q143R/M156Q/H224F | 152.1 | 7.2 | 5% | 0.39 | 3 |
| T128N/P129A/Q286R/M298Q/H373F | T[128]N/P[129]A/Q143R/M156Q/H224F | 182.6 | 43.2 | 24% | 0.46 | 5 |
| M298Q/H373F | M156Q/H224F | 81.7 | 10.5 | 13% | 0.21 | 2 |
| T128N/P129A/M156Q/H224F† | T[128]N/P[129]A/M156Q/H224F† | 89.1 | 3.8 | 4% | 0.18 | 2 |
| V21D/Q143R/E154V/M156Q | V21D/Q143R/E154V/M156Q | 85.0 | 14.7 | 17% | 0.22 | 13 |
| S222A/T239V | S82A/T99V | 967.3 | 282.6 | 29% | 2.46 | 5 |
| Gla swap FIX/S222A/T239V/Q286R | Gla swap FIX/S82A/T99V/Q143R | 2438.4 | 269.4 | 11% | 6.19 | 2 |
| Gla swap FIX/S222A/T239V/Q286R† | Gla swap FIX/S82A/T99V/Q143R† | 1343.5 | 507.1 | 38% | 2.67 | 3 |
| T239V/Q286R/M298Q | T99V/Q143R/M156Q | 3626.9 | 1465.9 | 40% | 9.21 | 4 |
| Gla swap FIX/T239V/Q286R/M298Q | Gla swap FIX/T99V/Q143R/M156Q | 483.7 | 65.6 | 14% | 1.23 | 2 |
| Gla swap FIX/T239V/Q286R/M298Q† | Gla swap FIX/T99V/Q143R/M156Q† | 314.3 | | | 0.62 | 1 |
| T128N/P129A/T239V/Q286R/M298Q† | T[128]N/P[129]A/T99V/Q143R/M156Q† | 266.4 | 52.1 | 20% | 0.53 | 2 |

TABLE 18-continued

Inhibition of FVIIa variants by AT-III/heparin in the absence of TF

| Mutation (mature FVII numbering) | Mutation (Chymotrypsin Numbering) | $K_{0.5}$ (nM) | SD | % CV | $K_{0.5\,mut}/K_{0.5\,wt}$ | n |
|---|---|---|---|---|---|---|
| S222A/T239V/H257A/Q286R/M298Q | S82A/T99V/H117A/Q143R/M156Q | 469.3 | 133.2 | 28% | 1.19 | 6 |
| T128N/P129A/S222A/T239V/H257A/Q286R/M298Q† | T[128]N/P[129]A/S82A/T99V/H117A/Q143R/M156Q† | 326.5 | 55.3 | 17% | 0.65 | 2 |
| T239V/Q286R/H373F | T99V/Q143R/H224F | 630.6 | 194.0 | 31% | 1.60 | 3 |
| T128N/P129A/T239V/Q286R/M298Q/H373F† | T[128N]/P[129]A/T99V/Q143R/M156Q/H224F† | 121.2 | 25.8 | 21% | 0.24 | 4 |
| V158D/T239I/E296V/M298Q | V21D/T99I/E154V/M156Q | 179.5 | 50.5 | 28% | 0.46 | 5 |
| T239I/Q286R | T99I/Q143R | 5823.0 | 2185.5 | 38% | 14.79 | 9 |
| S222A/T239I | S82A/T99I | 1149.8 | 12.8 | 1% | 2.92 | 2 |
| GlaSwapFIX/S222A/T239I/Q286R | Gla swap FIX/S82A/T99I/Q143R | 3313.1 | 130.3 | 4% | 8.41 | 2 |
| T239I/Q286R/M298Q | T99I/Q143R/M156Q | 1611.4 | 185.9 | 12% | 4.09 | 2 |
| Gla swap FIX/T239I/Q286R/M298Q | Gla swap FIX/T99I/Q143R/M156Q | 1171.3 | 104.5 | 9% | 2.97 | 2 |
| T128N/P129A T239I/Q286R/M298Q† | T[128N]/P[129]A T99I/Q143R/M156Q† | 917.0 | 60.5 | 7% | 1.82 | 3 |
| S222A/T239I/H257A/Q286R/M298Q | S82A/T99I/H117A/Q143R/M156Q | 1223.6 | 18.9 | 2% | 3.11 | 2 |
| T239I/Q286R/H373F | T99I/Q143R/H224F | 1007.6 | 29.8 | 3% | 2.56 | 2 |
| V158D/T239V/E296V/M298Q | V21D/T99V/E154V/M156Q | 67.7 | 16.6 | 24% | 0.17 | 4 |
| V158D/T239V/E296V/M298Q† | V21D/T99V/E154V/M156Q† | 67.1 | | | 0.13 | 1 |
| T239V/Q286R | T99V/Q143R | 1787.9 | 106.3 | 6% | 4.54 | 2 |
| T239I/Q286R/M298Q/H237F | T99I/Q143R/M156Q/H224F | 370.4 | 3.0 | 1% | 0.94 | 2 |
| T128N/P129A T239I/Q286R/M298Q H237F† | T[128]N/P[129]A T99I/Q143R/M156Q/H224F† | 316.6 | 24.7 | 8% | 0.63 | 2 |
| S222A/H257S/Q286R/M298Q | S82A/H117S/Q143R/M156Q | 526.7 | | | 1.34 | 1 |
| S222A/Q286R/M298Q/H373F | S82A/Q143R/M156Q/H224F | 163.2 | 46.9 | 29% | 0.41 | 4 |
| Gla swap FIX/S222A/Q286R/M298Q/H373F | Gla swap FIX S82A/Q143R/M156Q/H224F | 163.5 | 58.2 | 36% | 0.42 | 4 |
| S222A/Q286R/M298Q | S82A/Q143R/M156Q | 308.4 | 119.9 | 39% | 0.78 | 4 |
| Gla swap FIX/S222A/Q286R/M298Q | Gla swap FIX S82A/Q143R/M156Q | 266.3 | 104.2 | 39% | 0.68 | 4 |
| T128N/P129A/A175S/Q366V | T[128]N/P[129]A/A39S/Q217V | 332.6 | 56.2 | 17% | 0.84 | 3 |
| A122N/G124S/A175S/Q366V | A[122]N/G[124]S/A39S/Q217V | 336.1 | 11.0 | 3% | 0.85 | 3 |
| T128N/P129A/A175S/S222A | T[128]N/P[129]A/A39S/S82A | 1913.4 | | | 4.86 | 1 |
| A122N/G124S/A175S/S222A | A[122]N/G[124]S/A39S/S82A | 1548.6 | 394.1 | 25% | 3.93 | 2 |
| T128N/P129A/A175S/Q286R | T[128]N/P[129]A/A39S/Q143R | 9545.5 | 2797.3 | 29% | 24.24 | 2 |
| A122N/G124S/A175S/Q286R | A[122]N/G[124]S/A39S/Q143R | 6923.3 | | | 17.58 | 1 |
| Gla swap FIX/S222A/Q286R/H373F | Gla swap FIX/S82A/Q143R/H224F | 587.3 | 5.1 | 1% | 1.49 | 2 |
| H257A/Q286R/M298Q | H117A/Q143R/M156Q | 390.8 | | | 0.99 | 1 |
| Gla swap FIX/T128N/P129A/A175S/S222A/Q286R | Gla swap FIX/T[128]N/P[129]A/A39S/S82A/Q143R | 6486.4 | 148.2 | 2% | 16.47 | 2 |
| Gla swap FIX/A122N/G124S/A175S/S222A/Q286R | Gla swap FIX/A[122]N/G[124]S/A39S/S82A/Q143R | 5524.0 | 1434.1 | 26% | 14.03 | 2 |
| T128N/P129A/A175S/Q286R/M298Q | T[128]N/P[129]A/A39S/Q143R/M156Q | 2311.8 | 520.7 | 23% | 5.87 | 2 |
| A122N/G124S/A175S/Q286R/M298Q | A[122]N/G[124]S/A39S/Q143R/M156Q | 1954.2 | 450.7 | 23% | 4.96 | 2 |
| T128N/P129A/A175S/S222A/H257A/Q286R/M298Q | T[128]N/P[129]A/A39S/S82A/H117A/Q143R/M156Q | 3212.9 | 1140.7 | 36% | 8.16 | 2 |
| A122N/G124S/A175S/S222A/H257A/Q286R/M298Q | A[122]N/G[124]S/A39S/S82A/H117A/Q143R/M156Q | 2972.8 | 751.2 | 25% | 7.55 | 2 |
| T128N/P129A/A175S/Q286R/M298Q/H373F | T[128]N/P[129]A/A39S/Q143R/M156Q/H224F | 1132.4 | 441.3 | 39% | 2.88 | 2 |
| A122N/G124S/A175S/Q286R/M298Q/H373F | A[122]N/G[124]S/A39S/Q143R/M156Q/H224F | 1000.1 | 184.3 | 18% | 2.54 | 2 |
| V158D/Q286R/E296V/M298Q/H373F | V21D/Q143R/E154V/M156Q/H224F | 62.1 | 10.5 | 17% | 0.16 | 11 |
| M298Q/Q366N/H373F† | M156Q/Q217N/H224F | 90.8 | 4.8 | 5% | 0.18 | 2 |
| T239V/M298Q/H373F† | T99V/M156Q/H224F | 46.6 | 7.9 | 17% | 0.09 | 2 |
| T239I/M298Q/H373F† | T99I/M156Q/H224F | 178.7 | 29.7 | 17% | 0.36 | 2 |
| T128N/P129A/Q286R/M298Q/Q366N/H373F† | T[128]N/P[129]A/Q143R/M156Q Q217N/H224F | 148.3 | 12.9 | 9% | 0.29 | 2 |
| T239V/Q286R/M298Q/Q366N† | Q143R/M156Q/Q217N/T99V | 252.2 | 40.9 | 16% | 0.50 | 2 |
| T239I/Q286R/M298Q/Q366N† | T99I/Q143R/M156Q/Q217N | 813.2 | 105.1 | 13% | 1.62 | 2 |

†produced in CHOX cells
§produced in CHOX stable cell line clone 52-5F7

Example 6

In Vivo Assessment of FVIIa Polypeptide Procoagulant Activity

Mouse models of hemophilia A were established to assess the procoagulant activity of FVIIa polypeptides. Hemophilia A was induced in CD-1 mice by intraperitoneal administration of anti-FVIII antibodies, followed by surgical removal of the tips of the tails to initiate bleeding. Mice deficient in FVIII (FVIII$^{-/-}$ mice) also were used, but were not treated with anti-FVIII antibodies. The mice were then treated with FVIIa polypeptide and the amount of blood lost in 20 minutes was measured to determine the procoagulant activity of the FVIIa polypeptides.

A. In Vivo Assessment of Wild-Type FVIIa Procoagulant Activity

A mouse model of hemophilia A was established to assess the procoagulant activity of FVIIa polypeptides. Hemophilia A was induced in CD-1 mice by administration of anti-FVIII antibodies, followed by surgical removal of the tips of the tails to initiate bleeding. The mice were then treated with FVIIa polypeptide and the time taken to stop bleeding, and the amount of blood lost during this time, was measured to determine the procoagulant activity of the FVIIa polypeptides.

Male CD-1 mice were anesthetized by intraperitoneal administration of both thiobarbital sodium at 100 mg/kg, and ketamine at 100 mg/kg. Lidocaine was administered by subcutaneous injection into the ventral neck to reduce sensitivity. The trachea and carotid artery were cannulated through a small skin incision in the neck to facilitate unrestricted breathing and the administration of anti-Factor VIII antibody, recombinant human Factor VIIa (rhFVIIa) and/or modified FVII polypeptides.

Cannulated mice were administered 3.76 mg sheep-anti-human-FVIII antibody (Affinity Biologicals, lot IG129R4, 612 mouse BU/ml) in 40 µL. This dose was determined by conducting an initial dose response experiment with the antibody (using 0.376, 0.94, 1.88 and 3.76 mg of anti-human-FVIII), and assessing blood loss and bleeding time. After 20 minutes, the tails of the mice were placed in 15 mL tubes containing 39° C. phosphate buffered saline (PBS) for a period of 10 minutes. At 30 minutes, the tails were briefly removed from the PBS solution and the last 5 mm of the tails were severed to initiate bleeding. The time at which bleeding began was noted. The tails were then returned to the tube containing 39° C. PBS and allowed to bleed for 5 minutes (pre-bleed) to ensure that the mice had responded to the anti-FVIII antibody. Following the pre-bleed, the mice were administered FVIIa polypeptides or the vehicle in which the FVIIa proteins were prepared and delivered. FVIIa polypeptides were diluted in either PBS or a buffer composed of 52 mM sodium chloride, 10.2 mM calcium chloride dehydrate, 9.84 mM glycylglycine, 0.01% polysorbate 80 and 165 mM mannitol. The FVIIa preparations were administered at either 1, 3 or 10 mg/kg, in a volume equivalent to 3 mL/kg, via the carotid cannulae and the tails were placed in fresh tubes containing 39° C. PBS. The bleeding was monitored for a period of 20 minutes and the times at which bleeding stopped were noted. The total bleeding time was calculated as the sum of the duration of bleeding during the pre-bleed, and the duration of bleeding following administration of FVIIa polypeptides, or PBS or buffer.

To determine the amount of blood lost during the bleeding episodes, the contents of the 15 mL tubes were assayed for hemoglobin content. Triton X-100 was diluted 1 in 4 in sterile water and 100 µL was added to 1 mL of the samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in PBS and hemolysed as above with Triton X 100.

An experiment was conducted comparing rhFVIIa generated as described above with the commercially available recombinant human FVIIa (NovoSeven®, Novo Nordisk) and blood loss was assessed following administration of a 3 mg/kg dose of each protein. The blood loss in the vehicle group (buffer, n=15) was 671.9±57.89 µl over the 20 minute period. This was reduced by the rhFVIIa produced by Catalyst Biosciences to 264.1±56.59 µl and by NovoSeven® to 273.7±53.93 µl (n=14). This experiment demonstrated equivalency between the two proteins.

B. Analysis of the Coagulant Activity of FVIIa Variants in CD-1 Mice with Induced Hemophilia A Initial experiments were carried out to determine the dose required and time and duration of effect of anti-human-FVIII antibodies when given by the intraperitoneal route to induce hemophilia in CD-1 mice. For the first lot of anti-FVIII (lot 1; Affinity Biologicals, lot IG129R4), this was based initially on the dose used for the cannulation experiments, described above. The dose determined to cause a hemophilic state (uncontrolled bleeding over a 20 minute assay period) was 7.54 mg/mouse (80 µl of a 94.25 mg/ml stock solution). This lot had a neutralizing activity of 612 mouse BU/ml. For the second lot of anti-human FVIII (lot 2; Affinity Biologicals, lot IG1577R2, neutralizing activity of 474 mouse BU/ml) the dose used was 11.98 mg/mouse (120 µl of a 99.8 mg/ml stock solution) and was administered at 6 hours prior to tail cut.

To induce hemophilia, male CD-1 mice (25-35 g) were dosed intraperitoneally with lot 1 or lot 2 of anti-FVIII prior to the experiment. Male CD-1 and FVIII$^{-/-}$ mice were anesthetized by intraperitoneal administration of a ketamine/xylazine cocktail (45 mg/mL and 3.6 mg/mL, respectively, in saline) and placed on a heated platform (39° C.) to ensure there was no drop in body temperature. The procedure room was kept at a temperature of 82° F. Ten minutes prior to tail cut the tail was immersed in 10 mls of pre-warmed PBS (15 ml centrifuge tube; 39° C.). Eight to ten mice were injected with recombinant human FVIIa (Novoseven®, Novo Nordisk) or modified FVII polypeptides diluted in a buffer composed of 52 mM sodium chloride, 10.2 mM calcium chloride dehydrate, 9.84 mM glycylglycine, 0.01% polysorbate 80 and 165 mM mannitol via the tail vein in a single injection. Vehicle only also was injected into a group of mice as a control. If the injection was missed, the animal was excluded from the study. Injection with FVIIa polypeptide or vehicle was made 5 minutes prior to tail cut. A tail cut was made using a razor blade 5 mm from the end of the tail and blood was collected into PBS for a period of 20 minutes. At the end of the collection period, total blood loss was assessed. The collection tubes were mixed and a 1 ml aliquot of each sample was taken and assayed for hemoglobin content. Triton X-100 was diluted 1 in 4 in sterile water and 100 µL was added to the 1 mL samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in PBS and hemolysed as above with Triton X 100.

1. Dose Response Study Assessing Wild-Type FVIIa Coagulant Activity

A dose response study in which 0.3, 1 or 3 mg/kg of wild-type FVIIa was assessed also was performed. Mice that received the vehicle lost 1002.3±60.71 μL in the 20 minute assay. This was reduced significantly in mice that were administered 3 mg/kg of wild-type FVIIa, to 415.5±90.85 μL (p<0.05 using Kruskal-Wallis followed by Dunn's post test). Reducing the dose to 1 mg/kg resulted in blood loss of 679.57±83.95 μL and a lower dose of 0.3 mg/kg resulted in blood loss of 852.42±94.46 μL.

2. Initial Analysis of FVIIa Variant Coagulant Activity

The vehicle only injection was used as a control. Mice that received the vehicle only lost 915.2±105.6 μL in the 20 minute assay, which was reduced to 352±99.86 μL (mean±S.E.M) if mice were administered recombinant human FVIIa. The amount of blood lost was reduced even further to 165.8±48.41 μL if the mice were administered Q286R-FVIIa (i.e. FVIIa containing the Q286R mutation), to 141.3±43.77 μL with Q286R/M298Q-FVIIa or to 129.5±36.64 μL with V158D/E296V/M298Q-FVIIa. Mice administered S222A-FVIIa also exhibited reduced blood loss (to 225.7±62.75 μL) compared to mice administered wild-type FVIIa. Administration of Gla Swap FIX-FVIIa, Q366V-FVIIa or A122N/G124S-FVIIa resulted in approximately the same amount of blood loss as that observed in mice given recombinant human FVIIa (334.6±54.95 μL, 321.7±102.6 μL and 329.8±83.91 μL respectively), while mice that were administered H257A-FVIIa, S222A/Q286R-FVIIa, or H257A-FVIIa appeared to have slightly greater blood loss (390±107 μL, 447.3±127.7 μL and 443.7±139.5 μL respectively).

3. Dose Response Assessing FVIIa Variant Coagulant Activity

A dose response study in which 0.1, 0.3, 1 or 3 mg/kg of Q286R-FVIIa, S222A-FVIIa, Q286R/M298Q-FVIIa or V158D/E296V/M298Q-FVIIa were administered to the mice. Mice that received the vehicle only lost 915.2±105.6 μL of blood in the 20 minute assay. This was reduced significantly in mice that were administered 3 mg/kg of any of Q286R-FVIIa (141.3±43.77 μL), S222A-FVIIa (225.7±62.75 μL) or Q286R/M298Q-FVIIa (129.5±36.64 μL) (p<0.05 using Kruskal-Wallis followed by Dunn's post test). Reducing to the dose to 1 mg/kg resulted in blood loss of 641±96.48 μL in mice that received Q286R-FVIIa and 487.92±92.07 μL in mice that received S222A-FVIIa. Lower doses of this FVIIa variant resulted in approximately the same blood loss (817.71±107.94 μL and 900.34±115.77 μL for Q286R-FVIIa and S222A-FVIIa respectively) as observed in mice that received the vehicle control. In contrast, mice that received 1 mg/kg Q286R/M298Q-FVIIa had significantly reduced blood loss (69.36±15.55 μL) compared to the vehicle only control mice. At lower doses of 0.3 mg/kg and 0.1 mg/kg, blood loss was 538.3±94.04 μL and 664±121.6 μL, respectively. Mice receiving 0.3, 1 and 3 mg/kg of V158D/E296V/M298Q-FVIIa had blood loss of 754.49±121.6 μL, 481.95±114.22 μL and 133.25±50.09 μL respectively.

Additional dose response studies were carried out for Q286R-FVIIa, Q286R/M298Q-FVIIa and V158D/E296V/M298Q-FVIIa and the data combined with those above. In the experiments assessing the effect of Q286R-FVIIa, the group that received the vehicle lost 833.61±73.95 μL of blood. This was significantly reduced to 196.71±49.18 μL in mice that were treated with 3 mg/kg of Q286R-FVIIa. Reducing the dose to 1 mg/kg resulted in blood loss of 577.78±66.29 μL. When mice were dosed with 0.1 and 0.3 mg/kg of Q286R-FVIIa the blood loss was produced was similar to the vehicle control value (739.58±104.28 μL and 806.63±65.17 μL, respectively). In the experiments assessing the effect of Q286R/M298Q-FVIIa, the vehicle group produced blood loss of 902.42±88.04 μL, which was significantly reduced by treatment with both 1 and 3 mg/kg Q286R/M298Q-FVIIa to 145.17±38.89 μL and 140.76±33.36 μL of blood loss. Reducing the dose to 0.1 and 0.3 mg/kg resulted in blood loss values of 664.03±121.62 μL and 551.94±67.60 μL respectively. In the experiments assessing V158D/E296V/M298Q-FVIIa the vehicle control group demonstrated blood loss of 966.64±57.97 μL, which was significantly reduced by treatment with V158D/E296V/M298Q-FVIIa at 3 mg/kg to 128.19±27.73 μL. Reducing the dose to 1 mg/kg led to blood loss of 565.50±65.78 μL and reducing the dose further to 0.3 and 0.1 mg/kg produced blood loss which was similar to the control group (811.16±71.87 μL and 893.62±106.73 μL). Statistical analysis was made by Kruskal Wallis followed by Dunn's post test and significance was accepted when p<0.05.

4. Coagulant Activity of H216A-FVIIa, H373F-FVIIa, Q366D-FVIIa and Q366N-FVIIa at a Dose of 3 mg/kg.

A set of experiments tested H216A-FVIIa, H373F-FVIIa, Q366D-FVIIa and Q366N-FVIIa at a dose of 3 mg/kg. The vehicle only injection was used as a control. Mice that received the vehicle lost 915.2±105.6 μL in the 20 minute assay. This was reduced even further to 211.1±67.70 μL if mice were treated with H373F-FVIIa. Blood loss was less affected upon treatment with H216A-FVIIa, Q366D-FVIIa and Q366N-FVIIa, with values of 558.6±66.22, 577.1±151.4 and 477.1±112.6 μL respectively.

4. Coagulant Activity of Q286R/M298Q/Gla Swap FIX-FVIIa, S222A/H257A/Q286R/M158Q-FVIIa, Q286R/M298Q/K341D-FVIIa and Q286R/M298Q/H373F-FVIIa at a Dose of 3 mg/kg.

The coagulant activity of Q286R/M298Q/Gla swap FIX-FVIIa, S222A/H257A/Q286R/M158Q-FVIIa, Q286R/M298Q/K341D-FVIIa and Q286R/M298Q/H373F-FVIIa at a dose of 3 mg/kg was assessed in the CD-1 hemophilia mouse model. The vehicle only injection was used as a control. Mice that received the vehicle lost 803±92.18 μL in the 20 minute assay. This was reduced by treatment with S222A/H257A/Q286R/M158Q-FVIIa to 118.6±63.27 μL. Treatment with Q286R/M298Q/Gla swap FIX-FVIIa at 3 mg/kg reduced the blood loss compared to the vehicle group from 888.89±104.76 μL to 171.83±62.061 μL. In the experiments assessing Q286R/M298Q/K341D-FVIIa and Q286R/M298Q/H373F-FVIIa the blood loss from the vehicle group was 813.1±82.66 μL. This was reduced to 39.42±5.53 μL blood loss following treatment with Q286R/M298Q/H373F-FVIIa. Q286R/M298Q/K341D-FVIIa appeared to be less effective in the assay, resulting in blood loss of 636.7±121.6 μL.

5. Dose Response Study to Assess Coagulant Activity of S222A/H257A/Q286R/M158Q-FVIIa and Q286R/M298Q/H373F-FVIIa The dose response to S222A/H257A/Q286R/M158Q-FVIIa at 0.3, 0.5, 1 and 3 mg/kg was assessed. Mice that received the vehicle lost 832.48±71.70 μL in the 20 minute assay. This was reduced significantly in mice that were administered 3 mg/kg of S222A/H257A/Q286R/M158Q-FVIIa, to 118.63±63.27 μL (p<0.05 using Kruskal-Wallis followed by Dunn's post test). Reducing the dose to 1 and 0.5 mg/kg resulted in a significant reduction in blood loss (202.69±77.60 μL and 366.52±106.21 μL) and a lower dose of 0.3 mg/kg resulted in blood loss comparing more to vehicle levels (742.04±112 μL). A dose response to Q286R/M298Q/H373F-FVIIa at 0.1, 0.3, 1 and 3 mg/kg was also assessed and in this experiment mice that received the vehicle had blood loss of 813.15±82.66 μL. This was reduced significantly in mice that were treated with 3 mg/kg of Q286R/M298Q/H373F-FVIIa, to 39.42±5.52 μL (p<0.05 using Kruskal-Wallis followed by Dunn's post test). Reducing the dose to 1 and 0.3 mg/kg led to blood loss values of 208.10±105.12 and 508.9±155.8 μL respectively. The lowest dose tested of 0.1 mg/kg produced blood loss that was approaching vehicle control levels (733.5±152.88 μL).

C. Analysis of FVIIa Coagulant Activity in FVIII$^{-/-}$ Mice

A mouse model of hemophilia A using mice deficient in FVIII (FVIII$^{-/-}$ mice) also was used to assess the coagulant activity of FVIIa polypeptides, using the same protocols as described above except that the mice were not treated with anti-FVIII antibodies.

1. Dose Response Study Assessing Wild-Type FVIIa Coagulant Activity

Dose response studies to assess the coagulant activity of NovoSeven® and wild-type rhFVIIa in FVIII$^{-/-}$ mice at 0.3, 1, 3 and 6 mg/kg were performed. In the NovoSeven® experiment, the blood loss in the vehicle group was 912.79±38.32 μL, which was significantly reduced by NovoSeven® treatment at 6 and 3 mg/kg (to 361.74±55.28 μL and 586.98±60.56 μL; p<0.05 using Kruskal-Wallis followed by Dunn's post test). Reducing the dose to 1 mg/kg resulted in blood loss of 674.84±46.88 μL and at the lowest dose tested the value was 801.08±41.39 μL. In the wild-type rhFVIIa experiment, the vehicle control group produced blood loss of 904.08±15.38 μL. This was reduced significantly (p<0.05 using Kruskal-Wallis followed by Dunn's post test) by wild-type rhFVIIa at 6 mg/kg to 451.04±74.17 μL. Reducing the dose to 3 mg/kg produced a blood loss value of 695.75±60.50 μL while lowering the dose further to 1 and 0.3 mg/kg resulted in blood loss values near and at vehicle control levels (846.08±34.17 μL and 936.43±31.39 μL, respectively).

2. Dose Response Assessing Q143R-FVIIa, S222A-FVIIa, Q286R/M298Q-FVIIa and V158D/E296V/M298Q-FVIIa Coagulant Activity The first set of experiments tested recombinant human FVIIa (NovoSeven®, Novo Nordisk), V158D/E296V/M298Q-FVIIa, Q286R-FVIIa and S222A-FVIIa at 3 mg/kg. The vehicle only injection was used as a control. Mice receiving vehicle only had blood loss of 942.9±27.37 μL in the 20 minute assay. Treatment with NovoSeven® FVII, V158D/E296V/M298Q-FVIIa, Q143R-FVIIa and S222A-FVIIa reduced blood loss to 468±55.9 μL, 302.38±73.12 μL, 697.26±92.22 μL and 675.07±35.29 μL respectively. Q143R-FVIIa, when tested again in FVIII$^{-/-}$ mice at 3 mg/kg, demonstrated a reduced blood loss of 754.84±60.96 μL compared to the vehicle control group (935.54±51.96 μL). When assessed at 5 mg/kg, Q143R-FVIIa produced a further reduction in blood loss to 445.87±79.62 μL compared to the vehicle control group (960.42±24.5 μL).

The second sets of experiments were dose response studies in which V158D/E296V/M298Q-FVIIa and Q286R/M298Q-FVIIa were assessed at 0.3, 1 and 3 mg/kg. Treatment with V158D/E296V/M298Q-FVIIa at 3 mg/kg resulted in significant reduction in blood loss (375.62±74.22 μL) compared to the vehicle control (960.42±24.5 μL; p<0.05 using Kruskal-Wallis followed by Dunn's post test). Reducing the dose to 1 and 0.3 mg/kg led to blood loss values nearer control levels, of 834.76±54.38 μL and 841.62±68.99 μL respectively. A second experiment which assessed a different lot of V158D/E296V/M298Q-FVIIa produced a vehicle control blood loss value of 912.79±38.32 μL, which was significantly inhibited at 3 and 1 mg/kg (247.24±35.17 μL and 628.30±37.36 μL; p<0.05 using Kruskal-Wallis followed by Dunn's post test). Treatment with a lower dose of V158D/E296V/M298Q-FVIIa produced blood loss that was approaching control values (841.85±19.32 μL). In the experiment assessing the effect of Q286R/M298Q-FVIIa in FVIII$^{-/-}$, mice the vehicle group produced blood loss of 941.39±35.18 μL. This was significantly inhibited at a dose of 3 mg/kg, resulting in blood loss of 258.92±59.82 μL. At lower doses of 1 and 0.3 mg/kg the levels of blood loss produced were 616.82±78.43 μL and 924.9±38.01 μL, respectively.

D. Analysis of the Coagulant Activity of Additional FVIIa Variants in Using the Induced Hemophilia Model The coagulant activity of several FVIIa variants was assessed using the Induced Hemophilia Model (IHM) with CD-1 mice described in Example 6.B, above. The protocol was the same as described above, except for the assessment of the T128N/P129A-FVIIa variant and the M156Q/H224F-FVIIa variant, in which a different lots (third and fourth, respectively) of human anti-FVIII were used. For the third lot of anti-human FVIII (lot 3; Affinity Biologicals, lot IG1603R1, neutralizing activity of 418 mouse BU/ml) the dose used was 12.17 mg/mouse (120 μl of a 101.4 mg/ml stock solution), which was administered at 18 hours prior to tail cut. For the fourth lot of anti-human FVIII (lot 4; Affinity Biologicals, lot IG1639R1, neutralizing activity of 875 mouse BU/ml) the dose used was 8.04 mg/mouse (80 μl of a 100.45 mg/ml stock solution. The blood loss was measured as described above, and presented below in Table 19 as the percent inhibition (calculated using the average values for the variant of interest and dividing by the vehicle group), and the ED50 value (determined using non linear regression analysis (using GraphPad Prism® software, GraphPad Software, Inc.), constraining the top and bottom of the response curve with the blood loss observed with vehicle-treated and normal control animals, respectively.

TABLE 19

| Mutation (mature FVII numbering) | Mutation (Chymotrypsin numbering) | IHM Blood Loss; % Inhibition (1.5 mg/kg) | n | IHM Blood Loss; ED50 (mg/kg) | n |
|---|---|---|---|---|---|
| WT (NovoSeven ®) | WT (NovoSeven ®) | 61 | 1 | 0.7 | 1 |
| WT | WT | 59 | 1 | 0.75 | 1 |
| T128N/P129A | T[128]N/P[129]A | 78 | 1 | 0.5 | 1 |
| Gla swap FIX | Gla swap FIX | 63 | 1 | | |
| A122N/G124S | A[122]N/G[124]S | 64 | 1 | | |
| V158D/E296V/M298Q | V21D/E154V/M156Q | 86 | 3 | 0.5 | 3 |
| Q286R | Q143R | 76 | 2 | 0.55 | 2 |
| S222A | S82A | 75 | 1 | 0.45 | 1 |
| H257S | H117S | 50 | 1 | | |
| H373F | H224F | 78 | 1 | | |
| Q366V | Q217V | 64 | 1 | | |
| A175S | A39S | 58 | 1 | | |
| K109N/A175S | K[109]N/A39S | 60 | 1 | | |
| Q286R/H257A | Q143R/H117A | 58 | 1 | | |

TABLE 19-continued

| Mutation (mature FVII numbering) | Mutation (Chymotrypsin numbering) | IHM Blood Loss; % Inhibition (1.5 mg/kg) | n | IHM Blood Loss; ED50 (mg/kg) | n |
|---|---|---|---|---|---|
| Q286R/S222A | Q143R/S82A | 50 | 1 | | |
| Q286R/S222A/H257A | Q143R/S82A/H117A | 68 | 1 | | |
| Q286R/M298Q | Q143R/M156Q | 85 | 2 | 0.15 | 2 |
| Q286R/M298Q† | Q143R/M156Q† | 89 | 1 | 0.16 | 2 |
| Gla swap FIX/ Q286R/M298Q | Gla swap FIX/ Q143R/M156Q | 83 | 2 | 0.13 | 1 |
| S222A/H257A/Q286R/ M298Q | S82A/H117A/Q143R/M156Q | 85 | 1 | 0.2 | 1 |
| H257S/Q286R/Q366V | H117S/Q143R/Q217V | 46 | 1 | | |
| S222A/H257A/Q286R/ Q366V | S82A/H117A/Q143R/Q217V | 49 | 1 | | |
| Q286R/M298Q/Q366N | Q143R/M156Q/Q217N | 88 | 1 | | |
| Q286R/H373F | Q143R/H224F | 75 | 1 | | |
| Q286R/M298Q/H373F | Q143R/M156Q/H224F | 95 | 1 | 0.15 | 1 |
| M298Q/H373F | M156Q/H224F | 95 | 1 | 0.21 | 1 |
| Glaswap FIX/S222A/Q286R | Glaswap FIX/S82A/Q143R | 85 | 1 | 0.4 | 1 |
| V158D/Q286R/E296V/ M298Q | V21D/Q143R/E154V/M156Q | 95 | 1 | | |
| T128N/P129A/Q286R/ H373F | T[128]N/P[129]A/Q143R/H224F/ | 70 | 1 | | |

†FVIIa polypeptide produced from CHOX cells

E. Analysis of the Coagulant Activity of Additional FVIIa Variants in Using the Induced Hemophilia Model The coagulant activity of several FVIIa variants was assessed using the Induced Hemophilia Model (IHM) with CD-1 mice described in Example 6.B, above. The protocol was the same as described above, except that for these experiments lots 4 through 6 of anti-FVIII were used. The details for these lots were as follows: lot 4 (detailed above), for the fifth lot (lot 5; Affinity Biologicals, lot IG1593R2, neutralizing activity of 255 mouse BU/ml) the dose used was 12.25 mg/mouse (120 μl of a 102.1 mg/ml stock solution), which was administered at 6 hours prior to tail cut. For the sixth lot (lot 6; Affinity Biologicals, lot IG1703R2, neutralizing activity of 685 mouse BU/ml) the dose used was 8.02 mg/mouse (80 μl of a 100.2 mg/ml stock solution), which was administered at 4 pm on the day prior to experiment. The blood loss was measured as described above, and presented below in Table 20 as the percent inhibition (calculated using the average values for the variant of interest and dividing by the vehicle group), in each case all doses are shown with the corresponding inhibition values below, and the ED50 value (determined using non linear regression analysis (using GraphPad Prism® software, GraphPad Software, Inc.), constraining the top and bottom of the response curve with the blood loss observed with vehicle-treated and normal control animals, respectively. The 'n/group' refers to the amount of mice per group whereas the 'n' in reference to the ED50 calculation refers to the amount of experiments performed with the variant.

TABLE 20

| Mutation (mature FVII numbering) | Mutation (Chymotrypsin numbering) | IHM Blood Loss; % Inhibition at each dose (mg/kg) Dose (mg/kg) | | | n/ group | IHM Blood Loss; ED50 (mg/kg) | n |
|---|---|---|---|---|---|---|---|
| | | 0.1 | 0.3 | 1 | | | |
| H257A/Q286R | H117A/Q143R | | | 53 | 7-10 | | |
| M298Q | M156Q | 37 | 81 | 87 | 7-10 | 0.11 | 1 |
| M298Q/T128N/P129A | M156Q/T[128]N/P[129]A | 39 | 79 | 93 | 7-9 | 0.1 | 1 |
| Q286R/T128N/P129A | Q143R/T[128]N/P[129]A | 32 | 42 | 58 | 6-8 | 0.27 | 1 |
| Gla Swap FIX/T128N/P129A/ S222A/Q286R | GlaswapFIX/T[128]N/P[129]A/ S82A/Q143R | 27 | 45 | 62 | 6-8 | 0.27 | |
| Q286R/M298Q | Q143R/M156Q | 33 | 57 | 89 | 9-10 | 0.15 | 1 |
| Q286R/M298Q | Q143R/M156Q | 35 | 57 | 94 | 8-10 | 0.13 | 1 |
| Q286R/M298Q | Q143R/M156Q | 32 | 62 | 95 | 8-9 | 0.14 | 1 |
| Q286R/M298Q | Q143R/M156Q | 44 | 65 | 95 | 9 | 0.09 | 1 |
| Gla Swap FIX/Q286R/M298Q | Gla Swap FIX/Q143R/M156Q | 35, | 57 | 80 | 7-10 | 0.14 | 1 |
| T128N/P129A/Q286R/M298Q | T[128]N/P[129]A/ Q143R/M156Q | 47, | 83 | 91 | 9-14 | 0.1 | 1 |
| Gla Swap FIX/T128N/P129A/ Q286R/M298Q | Gla Swap FIX/T[128]N/P[129]A/ Q143R/M156Q | 15 | 71 | 96 | 7-9 | 0.17 | 1 |
| {GlaswapFIX/K43I}/Q286R/ M298Q | {GlaswapFIX/K[43]I}/Q143R/ M156Q | 49 | 65 | 80 | 7-9 | 0.08 | 1 |

TABLE 20-continued

| Mutation (mature FVII numbering) | Mutation (Chymotrypsin numbering) | IHM Blood Loss; % Inhibition at each dose (mg/kg) Dose (mg/kg) | | | n/ group | IHM Blood Loss; ED50 (mg/kg) | n |
|---|---|---|---|---|---|---|---|
| | | 0.1 | 0.3 | 1 | | | |
| GlaswapFIX/S52A/S60A/Q286R/M298Q/ | GlaswapFIX/S[52]A/S[60]A/Q143R/M156Q/ | 38 | 71 | 88† | 9-10 | 0.11 | 1 |
| {GlaswapFIX/K43I}/T128N/P129A/Q286R/M298Q | {GlaswapFIX/K[43]I}/T[128]N/P[129]A/Q143R/M156Q | 23 | 58 | 84 | 9 | 0.17 | 1 |
| S222A/H257A/Q286R/M298Q/T128N/P129A | S82A/H117A/Q143R/M156Q/T[128]N/P[129]A | 24 | 71 | 96 | 7-8 | 0.15 | 1 |
| Q286R/M298Q/Q366N | Q143R/M156Q/Q217N | 41 | 79 | 96 | 7-8 Vehicle only: n = 17 | 0.1 | 1 |
| T128N/P129A/Q286R/M298Q/Q366N | T[128]N/P[129]A/Q143R/M156Q/Q217N | 40 | 53 | 84 | 6-8 | 0.09 | 1 |
| {GlaswapFIX/K43I}/T128N/P129A/Q286R/M298Q/Q366N/ | {GlaswapFIX/K[43]I}/T[128]N/P[129]A/Q143R/M156Q/Q217N | 39 | 81 | 94 | 8-10 | 0.1 | 1 |
| T128N/P129A/Q286R/H373F | T[128]N/P[129]A/Q143R/H224F | | 26 | | 7-9 | | |
| T128N/P129A/Q286R/M298Q/H373F | T[128]N/P[129]A/Q143R/M156Q/H224F | 43 | 42 | 87 | 6-13 | 0.12 | 1 |
| M298Q/H373F | M156Q/H224F | 27 | 46 | 82 | 7-8 | 0.21 | 1 |
| T128N/P129A/M298Q/H373F | T[128]N/P[129]A/M156Q/H224F | 48 | 77 | 85† | 8-10 | 0.09 | 1 |
| V158D/E296V/M298Q/Q286R | V21D/E154V/M156Q/Q143R | 27, | 61 | 95 | 7-8 | 0.16 | 1 |
| GlaswapFIX/S222A/Q286R/T239V | GlaswapFIX/S82A/Q143R/T99V | 30, | 32 | 60 | 8-9 | 0.36 | 1 |
| Q286R/M298Q/T239V | Q143R/M156Q/T99V | 21 | 67 | 92 | 7 | 0.16 | 1 |
| GlaswapFIX/Q286R/M298Q/T239V | GlaswapFIX/Q143R/M156Q/T99V | 16 | 69 | 90 | 7-9 | 0.17 | 1 |
| T128N/P129A/T239V/Q286R/M298Q | T[128]N/P[129]A/T99V/Q143R/M156Q/ | 29 | 63 | 91 | 9 | 0.15 | 1 |
| S222A/T239V/H257A/Q286R/M298Q | S82A/T99V/H117A/Q143R/M156Q/ | 38 | 63 | 94 | 7-8 | 0.12 | 1 |
| T128N/P129A/S222A/T239V/H257A/Q286R/M298Q | T[128]N/P[129]A/S82A/T99V/H117A/Q143R/M156Q | 44 | 75 | 79 | 7-9 | 0.09 | 1 |
| T128N/P129A/T239V/Q286R/M298Q/H373F | T[128]N/P[129]A/T99V/Q143R/M156Q/H224F | 51 | 75 | 88 | 8-10 | 0.08 | 1 |
| V158D/T239I/E296V/M298Q | V21D/T99I/E154V/M156Q | 45 | 48 | 85 | 7-9 | 0.11 | 1 |
| T128N/P129A/T239I/Q286R/M298Q | T[128]N/P[129]A/T99I/Q143R/M156Q | 20 | 61 | 82 | 8-10 | 0.18 | 1 |
| V158D/T239V/E296V/M298Q | V21D/T99V/E154V/M156Q | 23 | 52 | 86 | 8-9 | 0.19 | 1 |
| T128N/P129A/T239I/Q286R/M298Q/H373F | T[128]N/P[129]A/T99I/Q143R/M156Q/H224F | 36 | 67 | 73 | 8-10 | 0.11 | 1 |
| M298Q/Q366N/H373F | M156Q/Q217N/H224F | 33 | 80 | 88 | 8-10 | 0.11 | 1 |
| T239V/M298Q/H373F | T99V/M156Q/H224F | 50 | 68 | 84 | 7-9 Vehicle only: n = 16 | 0.07 | 1 |
| T239I/M298Q/H373F | T99I/M156Q/H224F | 56 | 74 | 96 | 9-10 | 0.07 | 1 |
| T128N/P129A/Q286R/M298Q/Q366N/H373F | T[128]N/P[129]A/Q143R/M156Q/Q217N/H224F | 51 | 87 | 92 | 7-9 | 0.1 | 1 |
| T239V/Q286R/M298Q/Q366N | T99V/Q143R/M156Q/Q217N | 45 | 62 | 80 | 7-9 | 0.08 | 1 |
| T239I/Q286R/M298Q/Q366N | T99I/Q143R/M156Q/Q217N | 8 | 34 | 79 | 8-9 | 0.34 | 1 |

†Dose was 0.6 mg/kg

Example 7

Michaelis Menten Kinetics Constant Determination of the Amidolytic Activity of FVIIa on a Small Molecule Substrate The amidolytic activity of the FVII variants can be assessed by measuring the Michaelis Menten kinetics constant of the FVIIa polypeptide on the peptidyl substrate Spectrozyme FVIIa ($CH_3SO_2$-D-CHA-But-Arg-pNA.AcOH). Such an assay can be performed as follows.

Lipidated human purified tissue factor (Innovin, Dade Behring, VWR Cat#68100-390) is included in the assay to provide for optimal activity of FVIIa. The TF-FVIIa complex cleaves Spectrozyme FVIIa as a highly specific chromogenic substrate releasing a paranitroaniline-chromophore (pNA), which can be monitored by measuring absorption at 405 nm. Enzyme activity is determined by monitoring the absorbance at 405 nm of the free pNA generated as a function of time.

The reactions are performed at three different enzyme concentrations. For the reaction, the FVIIa variants are first diluted to 40 nM in 1× direct assay buffer (100 mM Tris pH 8.4, 100 mM NaCl, 5 mM $CaCl_2$, 0.01% BSA) in a 1.7 mL tube (low adhesion microfuge tubes from ISC Bioexpress). FVIIa is further diluted in the presence of TF (Innovin, Dade Behring) by diluting to 2 nM in a 12-well polypropylene reservoir (Axygen) as follows: 720 µl 5× direct buffer (500 mM Tris pH 8.4, 500 mM NaCl, 25 mM $CaCl_2$, 0.05% BSA), 180 µl 40 nM FVIIa, and 2700 µl 2×TF (6 nM stock solution reconstituted in 10 mL water). The diluted protease is incubated for 5 minutes at room temperature. The 2 nM stock of FVIIa is further diluted in 2-fold serial dilutions to give a 1 nM and 0.5 nM stock of protease, respectively, also in the presence of TF. The serial dilution reactions are as follows: first, 1800 µl of 2 nM stock of FVIIa/TF from above diluted into 360 µl 5× direct buffer, 900 µl 2×TF, and 540 µl water. This diluted stock is diluted again 1:1 into 1800 µl 1×TF in direct buffer.

A dilution plate of the substrate Spectrozyme FVIIa (American Diagnostica) is made. The stock solution of Spectrozyme FVIIa is made by reconstitution of the 50 moles vial in distilled water to 10 mM and stored at 4° C. Eighty µl (10 mM Spectrozyme FVIIa) and 60 µl+20 µl water (7.5 mM Spectrozyme FVIIa) of the 10 mM Spectrozyme FVIIa are added to wells in two adjacent columns of a 96-well polypropylene assay plate (Costar). The two wells are serially diluted 2-fold down each of the 8 wells of the respective column to make a series of 10× substrate concentrations ranging from 10 mM to 78 µM substrate down the wells of the first column and from 7.5 mM to 58.6 µM substrate down the wells of the second column.

Five µl of each Spectrozyme FVIIa substrate dilution is added to a 96-well clear half area assay plate (Costar). Forty five µl of each of the three FVIIa/TF dilutions are added to three groups of columns of the substrate series dilutions. During this step, care is taken to avoid introducing bubbles into the wells of the assay. If bubbles are introduced, they can be removed by pricking with a clean needle before the beginning of each assay. The plates are then mixed by shaking. Prior to initiation of the assay, the pathlength of the assay wells is measured using a Spectramax Gemini M5 plate reader spectrophotometer (Molecular Devices) by taking an endpoint reading and using the Pathcheck feature of the Soft-Max Pro software (Molecular Devices). The increase in absorbance at 405 nm is measured every 30 seconds for one hour at 37° C.

The SoftMax Pro software is used to convert the absorbance rate (milliunits/sec) to concentration of pNA released (µM/sec) by using the pathlength and the extinction coefficient of the pNA leaving group at 405 nm, 9600 $M^{-1}cm^{-1}$. The conversion equation is as follows: Rate×(1/60×1000)×(1/9600×Pathlength)×100000. The results for each concentration of protease are graphed using Graph Pad Prism software with the substrate concentration on the X-axis and the determined µM/sec rates on the Y-axis. Using Graph Pad Prism 4 software Km and Ymax is determined by fitting the data to a Michaelis Menten equation as follows:

$$Y=((k_{cat}K_m/1000000) \times X \times [E])/(1+(X+K_m)$$

where;
X is the substrate concentration (µM)
Y is the enzyme activity (µM/sec)
$k_{cat}K_m$ is the specificity constant ($M^{-1}sec^{-1}$)
$K_m$ is the Michaelis constant (µM)
E is the enzyme concentration (µM)
Initial values of E=1, Km=X at 0.5×Y max and $k_{cat}K_m$=1000 were set.

Example 8

Assessment of the Potency of the Interaction Between FVIIa Variants and TFPI The potency of the interaction between FVIIa polypeptides, such as those provided herein, and TFPI, can be assessed using one or more assays. In one example, the potency of the interaction between TFPI and a FVIIa/TF complex is assessed by measuring the level of inhibition of various concentrations of TFPI on the catalytic activity of a FVIIa/TF towards a substrate, Spectrazyme VIIa. In another example, a high-throughput surface plasmon resonance (SPR) assay can be used.

A. Determination of the $IC_{50}$ for TFPI Inhibition of FVIIa/TF

The potency of the interaction between TFPI and the FVIIa/TF complex was assessed by measuring the level of inhibition of various concentrations of TFPI on the catalytic activity of a FVIIa/TF towards a substrate, Spectrazyme VIIa. The concentration of TFPI that was required for 50% inhibition ($IC_{50}$) was calculated for each FVII variant, and a FVIIa standard.

A 96 well clear half area assay plate (Nunc) was pretreated by adding 150 µl/well of 1× plate buffer (100 mM Tris pH 8.4, 100 mM NaCl, 0.01% BSA, 0.01% Tween-20) to each well and incubating the plate at 37° C. for a minimum of 1 hour. The buffer was removed completely by shaking and blotting the plate and centrifuging the plate upside down to remove the remaining buffer. The plate was air-dried for 1 hour, and stored at room temperature (RT).

In a 1.7 ml microfuge tube (low adhesion microfuge tube from ISC Bioexpress), a mixture of FVIIa/TF was prepared in a total volume of 450 µl by mixing 9 µl of 250 nM FVIIa (American Diagnostica, wild-type FVIIa or a respective variant to be tested) was mixed with 337.5 µl of 2×TF (Innovin; Dade Behring; lyophilized product resuspended in 10 mL distilled water to generate 2×TF, which approximately equals 7 nM of lipidated TF), 90 µl 5× assay buffer (500 mM Tris pH 8.4, 500 mM NaCl, 25 mM $CaCl_2$, 0.05% BSA) and 13.5 µl of water, resulting in a solution containing 5 mM FVIIa and 5.2 nM TF. The mixture was incubated at room temperature for 5 minutes to allow the components to complex. To each well of 2 columns in the pretreated 96 well clear half area assay plate, 25 µl of the respective FVIIa/sTF mixture was added and the plate was covered to prevent evaporation.

Human Recombinant TFPI (R&D Systems) was initially dissolved in 33 µl 50% glycerol (v/v) to make a 10 µM stock for storage at −20° C. The TFPI stock was further diluted to 1.5 µM in a final 1× buffer (100 mM Tris pH 8.4, 100 mM NaCl, 5 mM $CaCl_2$, 0.01% BSA) in a polypropylene storage plate as follows: for each protease tested, 87.5 µl of a 1.5 µM solution of TFPI was made by mixing 13.1 µl 10 µM TFPI with 17.5 µl 5× assay buffer and 56.9 µl distilled water. Serial 3-fold dilutions of the TFPI solution were made in 1× assay buffer by mixing 27.5 µl TFPI into 55 µl 1× assay buffer, such that solutions containing 750 nM, 250 nM, 83.3 nM, 27.8 nM, 9.26 mM, 3.1 nM, and 1.03 nM TFPI were generated. The final well of the series contained only 1× buffer as a control.

Twenty-five µl of each dilution of TFPI was added to 2 wells (i.e. in duplicate) of 2 columns of the 96 well clear half area assay plate containing the FVIIa/TF mixture, such that the protease mixture was assayed in duplicate with each TFPI dilution. A solution of 1× assay buffer without TFPI also was added to 2 wells containing the FVIIa/TF mixture as a negative control. The plate was agitated briefly and then centrifuged at 3000 rpm for 5 minutes before incubation at 37° C. for 1.5 hours.

A stock solution of Spectrazyme VIa (American Diagnostica) was prepared by reconstituting 50 µmoles in 5 ml distilled water to 10 mM and storing at 4° C. until use. Immediately prior to use, the solution was diluted to 600 µM in distilled water. Following incubation of the assay plate from above, 10 µl of the diluted Spectrazyme VIIa was added to each well of the assay plate. The reactions were mixed and the plate was incubated at 37° C. The increase in absorbance at 405 nm was measured every 30 seconds for one hour at 37° C., and the absorbance rate were calculated using SoftMax Pro software (Molecular Devices).

To determine the degree of inhibition by TFPI, the absorbance rates of protease reactions containing TFPI were first divided by the absorbance rate of reactions containing no TFPI (the control sample) to obtain the fractional activity, and the $\log_{10}$ of each TFPI concentration was determined. Using GraphPad Prism Software, the $\log_{10}$[TFPI] was plotted against the fractional activity for each protease, and a dose response curve was generated with a curve fit that assumed the top and bottom of the activity data are fixed at 1 and 0, respectively. The software was used to determine TFPI inhibition as both the log IC$_{50}$ (pIC$_{50}$) value, and the absolute IC$_{50}$ (TFPI inhibition in nM) for each protease, and its average and standard deviated was determined.

The level of inhibition of TFPI of each of the FVIIa variants in complex with lipidated TF (Innovin; Dade Behring) was determined and expressed as the fold-increase of TFPI resistance compared to wild-type FVIIa (Table 21).

TABLE 21

Inhibition of FVIIa variants by TFPI

| Mutation (mature FVII numbering) | Mutation (chymotrypsin numbering) | TFPI fold resistance |
|---|---|---|
| wt | wt | 1.0 |
| A292N/A294S | A150N/A152S | 2.4 |
| A175S | A39S | 1.5 |
| K109N | K[109]N | 0.7 |
| A122N/G124S | A[122]N/G[124]S | 1.1 |
| A122N/G124S/E394N/ P395A/R396S | A[122]N/G[124]S/E245N/P246A/ R247S | 1.0 |

B. Surface Plasmon Resonance (SPR) Screening of FVIIa Variants for Resistance to TFPI The relative resistance of various FVIIa variants to inhibition by human recombinant soluble TFPI was evaluated using a high-throughput surface plasmon resonance (SPR) assay with the Biacore T100 instrument. The relative resistance of FVIIa variants to inhibition by TFPI was assessed by measurement of the relative amount of FVIIa variant bound to soluble TFPI immobilized on a Biacore CM5 sensor chip compared to the amount of wild-type FVIIa bound subsequent to a standardized injection time and protease concentration.

For every experiment, soluble TFPI (R&D Systems) was immobilized to a new 4-flow cell Biacore CM5 Series S sensor chip (GE Healthcare) using the amine coupling protocol available within the Biacore T-100 control Software (GE Healthcare) and the reagents provided with the Amine Coupling Kit (GE Healthcare). All four available flow cells were utilized for immobilization of two different densities of TFPI and bovine serum albumin (BSA), which served as a blocking agent in the reference cells. BSA was diluted to 5 µg/mL in sodium acetate (pH 4.0) and immobilized in flow-cells 1 and 3 at 1000 and 2000 response units (RU), respectively. For TFPI immobilization, lyophilized soluble TFPI (10 µg) was resuspended in 100 µL of 1× Coupling Buffer (30 mM Hepes, 135 mM NaCl, 1 mM EDTA, 0.01% Tween-20, pH 7.4) to a concentration of 0.1 mg/mL. A total of 20 µL of 0.1 mg/mL TFPI as diluted to 10 µg/mL in sodium acetate pH 4.0 for immobilization to flow-cells 2 and 4 at 1000 and 2000 RU, respectively. Coupling buffer was used as the running buffer during the immobilization steps.

Each sample of FVIIa was prepared at a final concentration of 320 nM in 1× Running Buffer (20 mM Hepes, 150 mM NaCl, 5 mM CaCl$_2$, 0.1% PEG 8000, 0.1% BSA, 0.01% Tween-20, pH 7.4) containing 620 nM sTF (Human Coagulation Factor III; R&D Systems). Generally, each FVIIa variant was diluted 10-fold into 1× Running Buffer before the final dilution of 320 nM. FVIIa/sTF complexes were prepared at a final volume of 120 µL in duplicate allowing for up to 48 unique FVIIa variants to be loaded into a 96-well storage plate and evaluated with duplicate injections in a single run. The FVIIa/sTF complex was incubated at RT for 10-15 min before initiation of the first sample injection.

A standardized binding analysis method was created within the Biacore Control Software (GE Healthcare) in which every FVIIa replicate is injected for 180 seconds of association time followed by a short 60 seconds of dissociation at a flow rate of 10 µL/min. Regeneration of the sensor chip followed the dissociation phase for 30 seconds with 10 mM glycine, 500 mM NaCl, pH 3.0 and then a 60 second stabilization period with 1× Running Buffer at the same 10 µL/min flow rate. Two assay reference points were recorded for each run and subsequent data analysis, one 5 seconds prior to the conclusion of the association phase (binding) and a second reported 5 seconds before the conclusion of the dissociation phase (dissociation). Before initiating a full assay, the sensor chip was tested with a single injection of 320 nM wild-type FVIIa/sTF for 180 seconds, which should give a response of approximately 400-450 RU and 750-850 RU for binding to flow-cells 2 (1000 RU) and 4 (200 RU), respectively.

Data analysis was performed first with the Biacore T100 Evaluation Software (GE Healthcare) to inspect the assay validation parameters, which include verifying that binding to the reference cell is minimal, baseline drift and the binding of control blank injections (running buffer). Data tables were generated within this application that indicated the amount of FVIIa variant bound (in RU) at both the binding report point and the dissociation report point. The data tables were subsequently exported for further analysis within the Microsoft Excel spreadsheet environment. The raw data points (RU bound) were corrected for control binding to the sensor chip and then a ratio of the amount of wild-type FVIIa bound (in RU) to the amount of FVIIa variant bound (in RU) was taken for each parameter and reported as Binding (wt/variant) and Dissociation (wt/variant). Table 22 present the results of the study. Resistance to TFPI inhibition is reflected as an increase in the ratio for one or both of the evaluated parameters. For instance, a Binding (wt/variant) or Dissociation (wt/variant) value of 20 for a particular FVIIa variant indicates that that variant is 20-fold more resistant to TFPI inhibition than wild-type FVIIa. Several variants exhibited increased resistance to TFPI inhibition. For example, variants containing the K341D mutation (mature FVII numbering) such as Q286R/M298Q/K341D-FVIIa, Q286R/K341D-FVIIa and M298Q/K341D-FVIIa, have ratios indicating significant resistance to TFPI (greater than 40-150-fold). In some cases, the rate of dissociation was affected more than the rate of association.

TABLE 22

Resistance of FVIIa variants to inhibition by TFPI

| | | TF-Dependent TFPI Resistance Assay | | | |
|---|---|---|---|---|---|
| | | 293-F Cells | | BHK-21 Cells | |
| Mutation (mature FVII Numbering) | Mutation (Chymotrypsin Numbering) | Binding (wt/ variant) | Dissociation (wt/ variant) | Binding (wt/ variant) | Dissociation (wt/ variant) |
| WT | WT | 1.0 | 1.0 | 1.0 | 1.0 |
| Q286R | Q143R | 2.2 | 1.9 | 3.7 | 3.4 |
| A292N/A294S | A150N/A152S | 2.6 | 2.2 | | |

TABLE 22-continued

Resistance of FVIIa variants to inhibition by TFPI

| | | TF-Dependent TFPI Resistance Assay | | | |
| | | 293-F Cells | | BHK-21 Cells | |
| Mutation (mature FVII Numbering) | Mutation (Chymotrypsin Numbering) | Binding (wt/variant) | Dissociation (wt/variant) | Binding (wt/variant) | Dissociation (wt/variant) |
| --- | --- | --- | --- | --- | --- |
| A175S | A39S | 1.6 | 1.4 | | |
| K109N | K[109]N | 0.8 | 0.7 | | |
| A122N/G124S | A[122]N/G[124]S | 1.2 | 1.1 | | |
| A122N/G124S/E394N/P395A/R396S | A[122]N/G[124]S/E245N/P246A/R247S | 1.1 | 1.0 | | |
| S119N/L121S | S[119]N/L[121]S | | | 1.2 | 1.3 |
| T128N/P129A | T[128]N/P[129]A | | | 1.1 | 1.2 |
| Q286R/S222A/Gla Swap FIX | Q143R/S82A/Gla swap FIX | 1.9 | 1.7 | | |
| Q286R/M298Q | Q143R/M156Q | | | 2.0 | 1.8 |
| Q286R/M298Q/K341Q | Q143R/M156Q/K192Q | 3.1 | 3.5 | 3.0 | 3.5 |
| Q286R/M298Q/K199E | Q143R/M156Q/K60cE | 4.6 | 4.1 | 2.4 | 2.1 |
| T239V | T99V | 1.4 | 1.4 | 1.1 | 1.1 |
| H257A/M298Q | H117A/M156Q | | | 2.4 | 2.7 |
| S222A/H257A/Q286R/M298Q | S82A/H117A/Q143R/M156Q | | | 1.6 | 1.4 |
| A175S/Q286R/Q366V | A39S/Q143R/Q217V | 4.2 | 3.5 | 3.5 | 2.9 |
| K109N/A175S | K[109]N/A39S | | | 3.4 | 3.2 |
| S222A/Q286R/Q366V | S82A/Q143R/Q217V | | | 1.2 | 1.2 |
| Q366I | Q217I | 0.6 | 0.5 | | |
| K197E/M298Q | K60aE/M156Q | 2.6 | 2.3 | | |
| Q286R/M298Q/K341D | Q143R/M156Q/K192D | 33.6 | 182.3 | | |
| Q286R/K341D | Q143R/K192D | 29.8 | 281.8 | | |
| M298Q/K341D | M156Q/K192D | 146.8 | 196.5 | | |
| S119N/L121S/A175S | S[119]N/L[121]S/A39S | 2.8 | 2.7 | | |
| T128N/P129A/A175S | T[128]N/P[129]A/A39S | 2.7 | 2.6 | | |
| A122N/G124S/A175S | A[122]N/G[124]S/A39S | 3.0 | 2.9 | | |

Example 9

Pharmacokinetic Analysis of FVIIa Polypeptides

Pharmacokinetic properties of FVIIa polypeptides were assessed by measuring the amount of human Factor VIIa in mouse plasma. Two assays can be used to quantify FVIIa in plasma. An ELISA can be used to quantify total FVIIa protein in mouse plasma and a FVIIa-dependant clotting assay (FVIIa:C) used to quantify coagulant activity of the FVIIa polypeptides in plasma.

A. Administration of FVIIa Polypeptides to Mice

Modified FVIIa polypeptides and the unmodified recombinant human FVIIa (rhFVIIa) protein (NovoSeven®, Novo Nordisk) were evaluated in pharmacokinetic studies. For each study, 18 male CD-1 mice were injected with an intravenous bolus dose (0.1-3.0 mg/kg, depending on the study) of rFVIIa. At 5, 15, 30, 60, 120, and 240 minutes post-injection, three mice from each injection protocol were euthanized using $CO_2$ asphyxiation and approximately 1.0 mL of blood was drawn into a 1.0 mL syringe via a percutaneous cardiac puncture. Each syringe was pre-loaded with sufficient sodium citrate to achieve a final concentration of 3.2% in 1 mL of blood. The blood samples were then centrifuged at 9000 rpm for 8 min at 4° C. The plasma was removed to labeled individual 1.5 ml tubes (Eppendorf), snap frozen in liquid nitrogen and stored at −80° C. Additionally, one mouse per experiment was injected with vehicle alone (sham) and plasma from this mouse was used for background FVIIa activity determination.

B. ELISA Assay

A commercially available kit, IMUBIND® Factor VII ELISA (American Diagnostica) was used to detect FVII protein in serum by ELISA. This kit employs a plate pre-coated with an anti-FVII/FVIIa antibody to capture the protein, and a biotinylated anti-FVII antibody for detection through a steptavidin labeled horseradish peroxidase. The kit was used according to the manufacturers' direction with the following exceptions: first, the standard curve has been narrowed to ensure a linear range over the entire concentration range and spans the concentrations of 0.88 ng/ml to 10 ng/ml; second, the purified FVIIa variant itself was used for the standard curve rather than the FVII standard provided with the kit because of differences in the antibody affinity. Experiments indicated that the complex of FVIIa with anti-thrombin III (ATIII), a potential plasma inhibitor of FVIIa, is detected at 75% of the level of the free protease, ensuring that the assay can detect the total FVIIa in the plasma sample in both the active and inactive forms.

Briefly, the plasma samples were thawed at room temperature and diluted 10 fold in sample buffer (PBS+0.1% Triton X-100+1.0% BSA) then diluted serially 5.5 fold for four dilutions. The four diluted samples were diluted 2 fold onto the ELISA plate for final sample dilutions of 20, 110, 605 and 3327.5 fold. These four dilutions of mouse plasma covered a range of protease concentrations from 33,000 ng/ml to 20 ng/ml. Each sample was measured on two separate assays plates, and those measurements within the range of the standard curve were used to calculate the concentration of FVIIa variant in the plasma sample C. Clotting Assay A commercially available kit (STACLOT FVIIa-rTF, Diagnostica Stago, Parsippany, N.J.) was used as the clotting assay. To determine the coagulant activity of the active FVIIa polypeptides, plasma samples were assayed using a FVIIa-dependant clotting assay (FVIIa:C). The assay was performed using reagents and instructions provided in a commercial kit and clotting time measured using an electromechanical clot detection instrument (STArt4, Diagnostica Stago, Parsippany, N.J.). The kit was used according to the manufacturers' direction with the following exceptions: first, the purified FVIIa variant itself was used for the standard curve rather than the rhFVIIa standard provided with the kit; second, the following bulk commercial reagents were used for routine pharmacokinetic screening studies and gave comparable results to the kit reagents: soluble tissue factor (CalBioChem, La Jolla, Calif.) and synthetic phospholipid blend (Avanti Polar Lipids, Alabaster, Ala.), TBSA buffer (Tris-NaCl, pH 7.5 with 1% BSA; DiaPharma, West Chester, Ohio), and 25 µM calcium chloride solution (Diagnostica Stago, Parsippany, N.J.).

The clotting assay was performed as follows. Frozen plasma samples were thawed at room temperature for approximately 45 min and then diluted 1:5000 in buffer. Fifty µl of the diluted plasma is combined with 50 µL Factor VII-deficient human plasma and 50 µL of relipidated tissue factor and pre incubated for 180 seconds. Following preincubation, 50 µL of calcium chloride solution (25 µM) was added to initiate clotting. Clotting time was determined using electromechanical clot detection. Each plasma sample was assayed in duplicate. The system was calibrated by constructing a standard curve using the clotting time of serial dilutions of buffer containing a known amount of the specific FVIIa variant being assayed. FVIIa concentrations in mouse plasma samples were calculated from the linear portion of the log FVIIa versus Log clotting time standard curve. The ability of plasma samples to induce clotting in Factor VII-deficient plasma was reported as ng FVIIa/mL of mouse plasma following background subtraction of endogenous wild type FVIIa in plasma from sham treated mice.

The half-life of each FVII protein was routinely determined by making a conventional fit of the natural log of the activity to a straight line, and measuring the time taken for the activity of FVIIa proteins to be reduced by half. For FVII proteins with multi exponential decay, half-life was determined from the terminal portion of the log plasma VS time profile. Additional pharmacokinetic parameters were calculated as follows: Plasma $AUC_{0-inf}$/Dose (calculated as $[AUC_{(0-t)}+Ct/(\ln 2/T_{1/2})]$, where t is the last time point with measurable plasma concentration of the FVIIa polypeptide divided by the IV dose (mg/kg)); half-life (the half life of the FVIIa polypeptide during the terminal phase of plasma FVIIa concentration-versus-time profile; $T_{1/2}$ is calculated as $-\ln 2$ divided by the negative slope during the terminal phase of the log-linear plot of the plasma FVIIa concentration-versus-time curve); $MRT_{0-last}$ (mean time the FVIIa polypeptide resides in body; calculated as $AUMC_{0-last}/AUC_{0-last}$, where $AUMC_{0-last}$ is the total area under the first moment-versus-time curve (FVIIa concentration time versus time curve), and is calculated by the linear trapezoid rule); Cl (systemic clearance; calculated as $Dose/AUC_{0-inf}$); and $V_d$ (volume of distribution based on the terminal elimination e constant ($\beta$); calculated as $[Cl/(\ln 2/T_{1/2})]$).

D. Pharmacokinetic Properties of FVIIa Variants

Using the above described FVIIa:C protocol, the pharmacokinetic properties of wild-type FVIIa and FVIIa variants were assessed based on clotting activity in plasma. The results are set forth in Table 23. Several FVIIa variants exhibited improved pharmacokinetic parameters compared to wild-type FVIIa.

TABLE 23

Mouse Pharmacokinetic Parameters of FVIIa Variants

| Mutation (mature FVII numbering) | IV Dose (mg/kg) | Plasma AUC0-inf (ug · min/mL)/Dose | Half-Life (min) | MRT0-last (min) | Cl (mL/min/kg) | Vd (mL/kg) | N |
|---|---|---|---|---|---|---|---|
| NovoSeven ® RT FVIIa | 0.1 | 1165 | 37 | 50 | 0.9 | 46 | 1 |
| NovoSeven ® FVIIa | 0.1 | 741 | 30 | 31 | 1.4 | 58 | 1 |
| NovoSeven ® FVIIa | 1.0 | 1156 | 36 | 41 | 1.7 | 89 | 1 |
| WT | 0.1 | 686 | 37 | 37 | 1.8 | 92 | 6 |
| WT | 1.0 | 798 | 50 | 57 | 1.5 | 118 | 2 |
| P257insGGGSCSFGRGDIRNVC | 0.1 | 391 | 32 | 32 | 2.3 | 108 | 1 |
| T128N/P129A | 0.1 | 1392 | 57 | 43 | 0.8 | 64 | 2 |
| S52A | 0.1 | 594 | 51 | 58 | 1.6 | 118 | 1 |
| K109N | 0.1 | 951 | 50 | 40 | 1.1 | 75 | 1 |
| A51N | 0.1 | 270 | 33 | 32 | 3.7 | 174 | 1 |
| S52A/S60A | 0.05 | 460 | 25 | 29 | 2.2 | 78 | 1 |
| S52A/S60A | 0.1 | 408 | 17 | 34 | 2.5 | 61 | 1 |
| M298Q | 0.1 | 258 | 76 | 33 | 4.9 | 443 | 2 |
| T128N/P129A/M298Q | 0.1 | 495 | 26 | 28 | 2.0 | 75 | 1 |
| V158D/E296V/M298Q | 0.05 | 72 | 13 | 10 | 13.9 | 258 | 1 |
| V158D/E296V/M298Q | 0.1 | 44 | 16(á), 45(á) | 20 | 22.8 | 1465 | 1 |
| V158D/E296V/M298Q | 1.0 | 39 | 7 | 13 | 26.6 | 979 | 2 |
| V158D/E296V/M298Q | 3.0 | 22 | 7.7á | 7.9 | 45.6 | 506 | 1 |
| V158D/E296V/M298Q | 6.0 | 48 | 43 | 45 | 20.8 | 1305 | 1 |
| T128N/P129A/V158D/E296V/M298Q | 0.1 | 125 | 11 | 14 | 8.0 | 122 | 1 |
| S52A/S60A/V158D/E296V/M298Q | 0.1 | 47 | 15 | 11 | 21.4 | 450 | 1 |
| Q286R | 0.1 | 181 | 55 | 59 | 5.5 | 439 | 1 |
| Q286R | 0.3 | 460 | 41.7 | 76 | 1.8 | 110 | 1 |
| Q286R | 1.0 | 1256 | 67 | 68 | 0.8 | 80 | 2 |
| T128N/P129A/Q286R | 0.1 | 2443 | 96 | 82 | 0.4 | 56 | 1 |
| S52A/S60A/Q286R | 0.1 | 1565 | 43 | 60 | 0.6 | 55 | 1 |
| Gla Swap FIX | 0.1 | 207 | 20 | 22 | 4.9 | 140 | 2 |
| K341D | 0.1 | 2817 | 106 | 114 | 0.1 | 22 | 1 |
| S222A | 0.1 | 189 | 32 | 33 | 5.3 | 248 | 1 |
| S222A | 1.0 | 139 | 30 | 33 | 3.8 | 293 | 1 |

TABLE 23-continued

Mouse Pharmacokinetic Parameters of FVIIa Variants

| Mutation (mature FVII numbering) | IV Dose (mg/kg) | Plasma AUC0-inf (ug · min/mL)/ Dose | Half-Life (min) | MRT0-last (min) | Cl (mL/min/kg) | Vd (mL/kg) | N |
|---|---|---|---|---|---|---|---|
| T128N/P129A/S222A | 0.1 | 422 | 28.4(á), 71(â) | 58 | 2.4 | 244 | 1 |
| S52A/S60A/S222A | 0.1 | 270 | 45 | 38 | 3.7 | 243 | 1 |
| H257A | 0.1 | 595 | 31 | 30 | 1.7 | 76 | 1 |
| H257S | 0.1 | 1015 | 59 | 62 | 1.0 | 84 | 1 |
| H257S | 0.75 | 816 | 50 | 62 | 1.2 | 85 | 1 |
| Q366V | 0.1 | 19 | 14 | 11 | 51.6 | 1060 | 1 |
| Gla SwapFIX/Q366V | 0.1 | 157 | 11 | 7.0 | 6.4 | 107 | 1 |
| A122N/G124S/E394N/P395A/R396S | 0.1 | 1089 | 63 | 45 | 0.9 | 84 | 1 |
| G318N | 1.0 | 568 | 95 | 56 | 1.8 | 242 | 1 |
| A175S | 0.1 | 2081 | 111 | 85 | 0.5 | 76 | 2 |
| K109N/A175S | 0.1 | 1280 | 183 | 51 | 0.8 | 207 | 1 |
| S119N/L121S/A175S | 0.1 | 2460 | 102 | 50 | 0.4 | 60 | 1 |
| T128N/P129A/A175S | 0.1 | 2770 | 83 | 48 | 0.4 | 43 | 1 |
| A122N/G124S/A175S | 0.1 | 3240 | 91 | 50 | 0.3 | 40 | 1 |
| A122N/G124S | 0.1 | 679 | 52.9 | 42 | 1.1 | 87 | 1 |
| H257A/Q286R | 0.1 | 1848 | 56.8 | 73 | 0.5 | 44 | 1 |
| S222A/Q286R | 0.1 | 861 | 30 | 38 | 1.5 | 97 | 2 |
| Gla SwapFIX/S222A/Q286R | 1.0 | 415 | 39 | 42 | 2.4 | 136 | 1 |
| Gla Swap FIX/T128N/P129A/S222A/Q286R | 0.1 | 929 | 55 | 59 | 1.1 | 86 | 1 |
| S222A/H257A/Q286R | 0.1 | 976 | 56 | 42 | 1.0 | 83 | 1 |
| Q286R/M298Q | 0.055 | 1198 | 40 | 44 | 0.8 | 49 | 1 |
| Q286R/M298Q | 0.1 | 605 | 35 | 42 | 1.9 | 94 | 6 |
| Q286R/M298Q | 1.0 | 363 | 29 | 36 | 2.8 | 116 | 1 |
| Gla Swap FIX/Q286R/M298Q | 0.1 | 231 | 26 | 20 | 4.9 | 194 | 3 |
| T128N/P129A/Q286R/M298Q | 0.1 | 1571 | 41 | 60 | 0.6 | 38 | 1 |
| T[128]N/P[129]A/Q286R/M298Q | 0.1 | 1326 | 42.3 | 50 | 0.8 | 47 | 1 |
| Gla Swap FIX/T128N/P129A/Q286R/M298Q | 0.1 | 427 | 30 | 32 | 2.3 | 101 | 1 |
| {Gla Swap FIX/E[40]L}/Q286R/M298Q | 0.1 | 386 | 53 | 43 | 2.6 | 198 | 1 |
| {Gla Swap FIX/K[43]I}/Q286R/M298Q | 0.1 | 439 | 85 | 47 | 2.3 | 280 | 1 |
| {Gla Swap FIX/Q[44]S}/Q286R/M298Q | 0.1 | 291 | 14 | 24 | 3.4 | 150 | 1 |
| {Gla Swap FIX/M[19]K}/Q286R/M298Q | 0.1 | 648 | 14(á), 75(â) | 43 | 1.5 | 32 | 1 |
| S52A/S60A/Q286R/M298Q | 0.1 | 374 | 32 | 34 | 2.7 | 122 | 1 |
| Gla Swap FIX/S52A/S60A/Q286R/M298Q | 0.1 | 256 | 19 | 18 | 3.9 | 107 | 1 |
| {Gla Swap FIX/K[43]I}/T128N/P129A/Q286R/M298Q | 0.1 | 154 | 18 | 17 | 6.5 | 166 | 1 |
| S222A/M298Q | 0.1 | 72 | 17 | 12 | 13.9 | 332 | 1 |
| S222A/H257A/Q286R/M298Q | 0.1 | 93 | 33 | 30 | 10.8 | 517 | 1 |
| T128N/P129A/S222A/H257A/Q286R/M2986Q | 0.1 | 770 | 38 | 45 | 1.3 | 72 | 1 |
| S52A/S60A/S222A/H257A/Q28R/M2986Q | 0.1 | 469 | 26 | 28 | 2.1 | 78 | 1 |
| A175S/Q286R/Q366V | 0.1 | 353 | 28.9 | 23 | 2.8 | 118 | 1 |
| Q286R/M298Q/K341D | 0.1 | 219 | 23 | 20 | 4.6 | 151 | 1 |
| M298Q/K341D | 0.1 | 2430 | 78 | 76 | 0.4 | 46 | 1 |
| Q286R/M298Q/Q366N | 0.1 | 569 | 29 | 32 | 1.8 | 74 | 1 |
| T128N/P129A/Q286R/M298Q/Q366N | 0.1 | 1897 | 50 | 58 | 0.5 | 38 | 1 |
| {Gla Swap FIX K[43]I}/Q286R/M298Q/Q366N | 0.1 | 257 | 10(á), 28(â) | 20 | 3.9 | 163 | 1 |
| {Gla Swap FIX K[43]I}/T128N/P129A/Q286R/M298Q/Q366N | 0.1 | 393 | 24 | 27 | 2.5 | 89 | 1 |
| T128N/P129A/Q286R/H373F | 0.1 | 1467 | 59 | 62 | 0.9 | 74 | 1 |
| Q286R/M298Q/H373F | 0.1 | 466 | 28 | 23 | 2.2 | 87 | 1 |
| T128N/P129A/Q286R/M298Q/H373F | 0.1 | 597 | 27(á), 67(â) | 51 | 1.6 | 153 | 1 |
| T128N/P129A/M298Q/H373F | 0.1 | 307 | 7(á), 27(â) | 23 | 3.3 | 126 | 1 |
| V158D/Q286R/E296V/M298Q | 0.1 | 172 | 14 | 36 | 5.8 | 535 | 1 |
| S222A/T239V | 0.1 | 127 | 47 | 39 | 7.9 | 535 | 1 |
| Gla Swap FIX/S222A/T239V/Q286R | 0.1 | 460 | 34 | 33 | 2.2 | 108 | 1 |

TABLE 23-continued

Mouse Pharmacokinetic Parameters of FVIIa Variants

| Mutation (mature FVII numbering) | IV Dose (mg/kg) | Plasma AUC0-inf (ug · min/mL)/Dose | Half-Life (min) | MRT0-last (min) | Cl (mL/min/kg) | Vd (mL/kg) | N |
|---|---|---|---|---|---|---|---|
| T239V/Q286R/M298Q | 0.1 | 398 | 28(á), 71(á) | 60 | 2.5 | 258 | 1 |
| Gla Swap FIX/T239V/Q286R/M298Q | 0.1 | 365 | 13(á), 56(á) | 29 | 2.7 | 220 | 1 |
| T128N/P129A/T239V/Q286R/M298Q | 0.1 | 914 | 38 | 36 | 1.1 | 60 | 1 |
| S222A/T239V/H257A/Q286R/M298Q | 0.1 | 181 | 28 | 31 | 5.5 | 225 | 1 |
| T128N/P129A/S222A/T239V/H257A/Q286R/M298Q | 0.1 | 564 | 27 | 30 | 1.8 | 70 | 1 |
| T239V/Q286R/H373F | 0.1 | 385 | 72 | 54 | 2.6 | 269 | 1 |
| T239V/Q286R/M298Q/H373F | 0.1 | 149 | 36 | 23 | 6.7 | 353 | 1 |
| T128N/P129A/T239V/Q286R/M298Q/H373F | 0.1 | 345 | 27 | 27 | 2.9 | 113 | 1 |
| V158D/T239I/E296V/M298Q | 0.1 | 370 | 14(á), 70(á) | 50 | 2.7 | 273 | 1 |
| T239I/Q286R | 0.1 | 1820 | 85 | 76 | 0.6 | 68 | 1 |
| S222A/T239I | 0.1 | 1300 | 6(á), 81(á) | 69 | 0.8 | 90 | 1 |
| Gla Swap FIX/S222A/T239I/Q286R | 0.1 | 1073 | 70 | 66 | 0.9 | 94 | 1 |
| T239I/Q286R/M298Q | 0.1 | 1029 | 27(á), 60(á) | 62 | 1.0 | 84 | 1 |
| Gla Swap FIX/T239I/Q286R/M298Q | 0.1 | 1269 | 54 | 62 | 0.8 | 61 | 1 |
| T128N/P129A/T239I/Q286R/M298Q | 0.1 | 2105 | 82 | 74 | 0.5 | 56 | 1 |
| S222A/T239I/H257A/Q286R/M298Q | 0.1 | 1212 | 31(á), 79(á) | 60 | 0.8 | 101 | 1 |
| T239I/Q286R/H373F | 0.1 | 1841 | 30(á), 85(á) | 69 | 0.5 | 62 | 1 |
| V158D/T239V/E296V/M296Q | 0.1 | 184 | 24(á), 134(á) | 78 | 5.4 | 1053 | 1 |
| T239V/Q286R | 0.1 | 1522 | 29(á), 72(á) | 68 | 0.7 | 68 | 1 |
| T239V/Q286R/M298Q/H373F | 0.1 | 950 | 36 | 61 | 1.1 | 55 | 1 |
| T239V/Q286R/M298Q/H373F | 0.1 | 806 | 32 | 56 | 1.3 | 57 | 2 |
| T239V/Q286R/M298Q/H373F | 0.1 | 663 | 27 | 52 | 1.5 | 59 | 1 |
| T239V/Q286R/M298Q/H373F | 0.1 | 1350 | 53 | 62 | 0.7 | 57 | 1 |
| S222A/H257S/Q286R/M298Q | 0.1 | 814 | 33 | 31 | 1.2 | 59 | 1 |
| H257S/Q286R/M298Q/H373F | 0.1 | 297 | 34 | 34 | 3.4 | 163 | 1 |
| S222A/Q286R/M298Q/H373F | 0.1 | 106 | 35 | 23 | 9.4 | 478 | 1 |
| Gla Swap FIX/S222A/Q286R/M298Q/H373F | 0.1 | 104 | 9.1(á), 17(á) | 13 | 9.7 | 242 | 1 |
| S222A/Q286R/M298Q | 0.1 | 347 | 24 | 26 | 2.9 | 102 | 1 |
| Gla Swap FIX/S222A/Q286R/M298Q | 0.1 | 263 | 11 | 13 | 3.8 | 62 | 1 |
| T128N/P129A/A175S/Q366V | 0.1 | 2196 | 52(á), 85(á) | 78 | 0.5 | 56 | 1 |
| A122N/G124S/A175S/Q366V | 0.1 | 2148 | 92 | 81 | 0.5 | 62 | 1 |
| T128N/P129A/A175S/S222A | 0.1 | 4248 | 122 | 88 | 0.2 | 41 | 1 |
| A122N/G124S/A175S/S222A | 0.1 | 3316 | 102 | 83 | 0.3 | 44 | 1 |
| T128N/P129A/A175S/Q286R | 0.1 | 6160 | 151 | 94 | 0.2 | 35 | 1 |
| A122N/G124S/A175S/Q286R | 0.1 | 4097 | 139 | 93 | 0.2 | 49 | 1 |
| Gla Swap FIX/S222A/H373F | 0.1 | 480 | 26 | 30 | 2.1 | 79 | 1 |
| V258D/E296V/M298Q/H373F | 0.1 | 90 | 8.7(á), 20(á) | 14 | 11.1 | 321 | 1 |
| H257A/Q286R/M298Q | 0.1 | 1029 | 42 | 48 | 1.0 | 59 | 1 |
| Gla Swap FIX/T128N/P129A/A175S/S222A/Q286R | 0.1 | 2787 | 38(á), 134(á) | 88 | 0.4 | 69 | 1 |
| Gla Swap FIX/A122N/G124S/A175S/S222A/Q286R | 0.1 | 3492 | 148 | 95 | 0.3 | 61 | 1 |
| T128N/P129A/A175S/Q286R/M298Q | 0.1 | 5120 | 171 | 96 | 0.2 | 48 | 1 |
| A122N/G124S/A175S/Q286R/M298Q | 0.1 | 3681 | 154 | 92 | 0.3 | 61 | 1 |
| T128N/P129A/A175S/S222A/H257A/Q286R/M298Q | 0.1 | 3140 | 113 | 87 | 0.3 | 52 | 1 |
| A122N/G124S/A175S/S222A/H257A/Q286R/M298Q | 0.1 | 2659 | 37.(á), 130(á) | 85 | 0.4 | 70 | 1 |
| T128N/P129A/A175S/Q286R/M298Q/H373F | 0.1 | 3580 | 118 | 88 | 0.3 | 48 | 1 |

TABLE 23-continued

Mouse Pharmacokinetic Parameters of FVIIa Variants

| Mutation (mature FVII numbering) | IV Dose (mg/kg) | Plasma AUC0-inf (ug·min/mL)/Dose | Half-Life (min) | MRT0-last (min) | Cl (mL/min/kg) | Vd (mL/kg) | N |
|---|---|---|---|---|---|---|---|
| A122N/G124S/A175S/Q286R/M298Q/H373F | 0.1 | 3148 | 105 | 84 | 0.3 | 48 | 1 |
| V158D/Q286R/E296V/M298Q/H373F | 0.1 | 124 | 20 | 17 | 8.1 | 237 | 1 |
| M298Q/H373F/Q366N | 0.1 | 169 | 8 | 8.2 | 5.9 | 69 | 1 |
| T239V/M298Q/H373F | 0.1 | 110 | 18 | 16 | 9.1 | 235 | 1 |
| T239I/M298Q/H373F | 0.1 | 562 | 26 | 28 | 1.8 | 66 | 1 |
| T128N/P129A/Q286R/M298Q/Q366N/H373F | 0.1 | 607 | 29 | 30 | 1.6 | 69 | 1 |
| T239V/Q286R/M298Q/Q366N | 0.1 | 729 | 29 | 30 | 1.4 | 57 | 1 |
| T239I/Q286R/M298Q/Q366N | 0.1 | 1548 | 72 | 73 | 0.6 | 67 | 1 |

α = alpha half life, measuring distribution half life
β = beta half life, measuring elimination half life Table 24 sets forth the results of the study using the following pharmacokinetic parameters: % Recovery (in vivo) (the measured plasma concentration of FVIIa at 5 minutes post-dose (first time point) divided by the theoretical maximum FVIIa plasma concentration (based on administered FVIIa mass and theoretical total blood volume) times 100%); % Recovery (in vitro)(the measured FVIIa concentration in plasma spiked with a known amount of FVIIa divided by the theoretical FVIIa plasma concentration (based on amount of FVIIa mass spiked into a known plasma volume) times 100%); AUC*Activity/Dose (TF-Dependent) (the plasma AUC/Dose multiplied by the TF-Dependent Indirect Activity (see Table 15, above); Improvement in Activity Exposure over NovoSeven® FVIIa (TF-Dependent) (calculated by AUC*Activity/Dose (TF-Dependent)$_{NovoSeven® FVIIa}$/AUC*Activity/Dose (TF-Dependent)$_{Mutant FVIIa}$); AUC*Activity/Dose (TF-Independent) (the plasma AUC/Dose multiplied by the TF-Independent Indirect Activity (see Table 15, above); Improvement in Activity Exposure over NovoSeven® FVIIa (TF-Independent) (calculated by AUC*Activity/Dose (TF-Independent)$_{NovoSeven® FVIIa}$/AUC*Activity/Dose (TF-Independent)$_{Mutant FVIIa}$).

TABLE 24

| Mutation (mature FVII numbering) | % Recovery (in vivo) | AUC * Activity/Dose (TF-Dependent) | Improvement in Activity Exposure over Novo7 (TF-Dependent) | AUC * Activity/Dose (TF-Independent) | Improvement in Activity Exposure over Novo7 (TF-Independent) |
|---|---|---|---|---|---|
| NovoSeven ® FVIIa | 60% | 2.95E+10 | 1.0 | 7.26E+03 | 1.0 |
| WT | 46% | 4.71E+10 | 1.4 | 1.22E+04 | 1.5 |
| T239I/Q286R/M298Q/Q366N | 52% | 1.15E+11 | 3.9 | 1.38E+05 | 18.9 |
| T239V/Q286R/M298Q/Q366N | 66% | 1.35E+11 | 4.6 | 4.69E+04 | 6.5 |
| T128N/P129A/Q286R/M298Q/Q366N/H373F | 66% | 8.10E+10 | 2.8 | 9.77E+04 | 13.5 |
| T239I/M298Q/H373F | 60% | 1.95E+10 | 0.7 | 7.77E+04 | 10.7 |
| T239V/M298Q/H373F | 17% | 4.89E+09 | 0.2 | 3.53E+04 | 4.9 |
| M298Q/H373F/Q366N | 32% | 1.19E+10 | 0.4 | 2.13E+04 | 2.9 |
| V158D/Q286R/E296V/M298Q/H373F | 21% | 2.97E+10 | 1.0 | 7.12E+04 | 9.8 |
| A122N/G124S/A175S/Q286R/M298Q/H373F | 79% | 2.64E+11 | 9.0 | ND | ND |
| T128N/P129A/A175S/Q286R/M298Q/H373F | 85% | 2.05E+11 | 7.0 | ND | ND |
| A122N/G124S/A175S/S222A/H257A/Q286R/M298Q | 76% | 2.23E+11 | 7.6 | ND | ND |
| T128N/P129A/A175S/S222A/H257A/Q286R/M298Q | 69% | 2.16E+11 | 7.4 | 6.36E+04 | 8.8 |
| A122N/G124S/A175S/Q286R/M298Q | 84% | 2.73E+11 | 9.3 | ND | ND |
| T128N/P129A/A175S/Q286R/M298Q | 76% | 3.69E+11 | 12.6 | ND | ND |
| Gla Swap FIX/A122N/G124S/A175S/S222A/Q286R | 42% | 1.44E+11 | 4.9 | ND | ND |

TABLE 24-continued

| Mutation (mature FVII numbering) | % Recovery (in vivo) | AUC * Activity/ Dose (TF-Dependent) | Improvement in Activity Exposure over Novo7 (TF-Dependent) | AUC * Activity/ Dose (TF-Independent) | Improvement in Activity Exposure over Novo7 (TF-Independent) |
|---|---|---|---|---|---|
| Gla Swap FIX/T128N/P129A/A175S/S222A/Q286R | 69% | 1.08E+11 | 3.7 | 8.51E+04 | 11.7 |
| H257A/Q286R/M298Q | 42% | 1.16E+11 | 4.0 | 6.33E+04 | 8.7 |
| V258D/E296V/M298Q/H373F | 17% | 1.36E+10 | 0.5 | 1.17E+05 | 16.1 |
| Gla Swap FIX/S222A/Q286R/H373F | 42% | 5.88E+10 | 2.0 | 3.90E+04 | 5.4 |
| A122N/G124S/A175S/Q286R | 78% | 1.68E+11 | 5.8 | 1.22E+04 | 1.7 |
| T128N/P129A/A175S/Q286R | 34% | 2.05E+11 | 7.0 | 2.01E+04 | 2.8 |
| A122N/G124S/A175S/S222A | 60% | 6.90E+10 | 2.4 | ND | ND |
| T128N/P129A/A175S/S222A | 88% | 7.31E+10 | 2.5 | 8.00E+03 | 1.1 |
| A122N/G124S/A175S/Q366V | 60% | 6.48E+10 | 2.2 | 6.42E+03 | 0.9 |
| T128N/P129A/A175S/Q366V | 74% | 7.43E+10 | 2.5 | 7.39E+03 | 1.0 |
| Gla Swap FIX/S222A/Q286R/M298Q | 40% | 5.52E+10 | 1.9 | 1.09E+05 | 15.0 |
| S222A/Q286R/M298Q | 22% | 4.46E+10 | 1.5 | 8.78E+04 | 12.1 |
| Gla Swap FIX/S222A/Q286R/M298Q/H373F | 16% | 2.94E+10 | 1.0 | 1.99E+04 | 2.7 |
| S222A/Q286R/M298Q/H373F | 5% | 1.57E+10 | 0.5 | 4.57E+04 | 6.3 |
| H257S/Q286R/M298Q/H373F | 20% | 4.52E+10 | 1.5 | 9.01E+03 | 1.2 |
| S222A/H257S/Q286R/M298Q | 72% | 1.28E+11 | 4.4 | 3.39E+04 | 4.7 |
| T239I/Q286R/M298Q/H373F | 56% | 8.73E+10 | 3.0 | 1.05E+04 | 1.5 |
| T239V/Q286R | 66% | 1.35E+11 | 4.6 | 1.79E+04 | 2.5 |
| V158D/T239V/E296V/M296Q | 8% | 4.08E+10 | 1.4 | 3.43E+05 | 47.3 |
| T239I/Q286R/H373F | 77% | 1.14E+11 | 3.9 | ND | ND |
| S222A/T239I/H257A/Q286R/M298Q | 61% | 1.38E+11 | 4.7 | 6.26E+04 | 8.6 |
| T128N/P129A/T239I/Q286R/M298Q | 81% | 1.72E+11 | 5.9 | 1.64E+05 | 22.6 |
| Gla Swap FIX/T239I/Q286R/M298Q | 56% | 1.59E+11 | 5.4 | 3.10E+05 | 42.6 |
| T239I/Q286R/M298Q | 54% | 1.16E+11 | 4.0 | 1.16E+04 | 1.6 |
| Gla Swap FIX/S222A/T239I/Q286R | 42% | 7.27E+10 | 2.5 | 2.18E+04 | 3.0 |
| S222A/T239I | 71% | 3.97E+10 | 1.4 | 2.19E+03 | 0.3 |
| T239I/Q286R | 56% | 1.05E+11 | 3.6 | 8.34E+03 | 1.1 |
| V158D/T239I/E296V/M298Q | 34% | 5.38E+10 | 1.8 | 8.01E+04 | 11.0 |
| T239V/Q286R/M298Q/H373F | 10% | 2.54E+10 | 0.9 | 6.07E+03 | 0.8 |
| T239V/Q286R/H373F | 16% | 4.09E+10 | 1.4 | 4.69E+03 | 0.6 |
| T128N/P129A/S222A/T239V/H257A/Q286R/M298Q | 49% | 6.84E+10 | 2.3 | 1.01E+05 | 13.9 |
| S222A/T239V/H257A/Q286R/M298Q | 15% | 3.87E+10 | 1.3 | 2.59E+04 | 3.6 |
| T128N/P129A/T239V/Q286R/M298Q | 60% | 9.47E+10 | 3.2 | 2.10E+05 | 28.9 |
| (Gla Swap FIX/T239V/Q286R/M298Q | 34% | 9.24E+10 | 3.2 | 1.01E+05 | 14.0 |
| T239V/Q286R/M298Q | 21% | 6.85E+10 | 2.3 | 1.17E+04 | 1.6 |
| Gla Swap FIX/S222A/T239V/Q286R | 33% | 9.32E+10 | 3.2 | 7.99E+03 | 1.1 |
| S222A/T239V | 10% | 9.52E+09 | 0.3 | 3.83E+02 | 0.1 |
| V158D/Q286R/E296V/M298Q | 15% | 2.56E+10 | 0.9 | 1.76E+05 | 24.3 |

TABLE 24-continued

| Mutation (mature FVII numbering) | % Recovery (in vivo) | AUC * Activity/ Dose (TF-Dependent) | Improvement in Activity Exposure over Novo7 (TF-Dependent) | AUC * Activity/ Dose (TF-Independent) | Improvement in Activity Exposure over Novo7 (TF-Independent) |
|---|---|---|---|---|---|
| T128N/P129A/Q286R/M298Q/H373F | 36% | 7.92E+10 | 2.7 | 1.83E+04 | 2.5 |
| Q286R/M298Q/H373F | 66% | 1.39E+11 | 3.9 | 1.42E+05 | 12.1 |
| T128N/P129A/Q286R/H373F | 49% | 2.03E+11 | 6.9 | 1.93E+04 | 2.7 |
| {Gla Swap FIX K[43]I}/T128N/P129A Q286R/M298Q/Q366N | 45% | 9.88E+10 | 3.4 | 8.58E+04 | 11.8 |
| {Gla Swap FIX K[43]I}/Q286R/M298Q/Q366N | 36% | 4.35E+10 | 1.5 | 2.18E+04 | 3.0 |
| Q286R/M298Q/Q366N | 41% | 1.33E+11 | 4.5 | 7.50E+04 | 10.3 |
| M298Q/K341D | 84% | 4.26E+10 | 1.0 | 1.02E+04 | 0.6 |
| Q286R/M298Q/K341D | 33% | 4.98E+09 | 0.1 | 5.24E+03 | 0.3 |
| A175S/Q286R/Q366V | 22% | 3.72E+10 | 0.9 | 7.31E+03 | 0.4 |
| S52A/S60A/S222A/H257A/Q28R/M2986Q | 45% | 1.17E+11 | 4.0 | 5.42E+04 | 7.5 |
| T128N/P129A/S222A/H257A/Q286R/M2986Q | 53% | 1.80E+11 | 6.1 | 5.23E+04 | 7.2 |
| S222A/H257A/Q286R/M298Q | 9% | 3.04E+10 | 0.9 | 4.17E+04 | 4.9 |
| S222A/M298Q | 7% | 8.63E+09 | 0.2 | 9.51E+04 | 5.1 |
| {Gla Swap FIX/K[43]I}/T128N/P129A/Q286R/M298Q | 23% | 2.46E+08 | 0.0 | 6.00E+04 | 8.3 |
| Gla Swap FIX/S52A/S60A/Q286R/M298Q | 32% | 4.63E+10 | 1.6 | 2.54E+05 | 34.9 |
| S52A/S60A/Q286R/M298Q | 31% | 4.67E+10 | 1.6 | 8.11E+04 | 11.2 |
| {Gla Swap FIX/M[19]K}/Q286R/M298Q | 69% | 9.11E+10 | 3.1 | 3.32E+05 | 45.7 |
| {Gla Swap FIX/Q[44]S}/Q286R/M298Q | 35% | 5.77E+10 | 2.0 | 2.12E+05 | 29.2 |
| {Gla Swap FIX/K[43]I}/Q286R/M298Q | 28% | 1.20E+11 | 4.1 | 3.96E+05 | 54.5 |
| {Gla Swap FIX/E[40]L}/Q286R/M298Q | 36% | 8.04E+10 | 2.7 | 3.14E+05 | 43.3 |
| Gla Swap FIX/T128N/P129A/Q286R/M298Q | 84% | 9.00E+10 | 3.1 | 3.58E+04 | 4.9 |
| T[128]N/P[129]A/Q286R/M298Q | 66% | 1.55E+11 | 5.3 | 2.20E+05 | 30.3 |
| T[128]N/P[129]A/Q286R/M298Q | 62% | 4.21E+11 | 14.4 | 1.84E+05 | 25.4 |
| Q143R/M156Q/Gla swap FIX | 21% | 8.53E+10 | 2.7 | 2.30E+05 | 29.9 |
| Q286R/M298Q | 51% | 1.08E+11 | 3.2 | 1.03E+05 | 11.2 |
| S222A/H257A/Q286R | 40% | 1.55E+11 | 4.4 | 2.72E+04 | 3.2 |
| Gla Swap FIX/T128N/P129A/S222A/Q286R | 44% | 1.37E+11 | 4.7 | 1.44E+04 | 2.0 |
| Gla SwapFIX/S222A/Q286R | 32% | 5.95E+10 | 1.4 | 2.15E+04 | 1.2 |
| S222A/Q286R | 51% | 1.85E+11 | 5.4 | 4.61E+04 | 2.5 |
| H257A/Q286R | 63% | 3.66E+11 | 12.5 | 1.59E+04 | 2.2 |
| A122N/G124S/A175S | 82% | 8.70E+10 | 2.4 | 2.18E+04 | 1.2 |
| T128N/P129A/A175S | 80% | 6.16E+10 | 1.7 | ND | ND |
| S119N/L121S/A175S | 60% | 8.68E+10 | 2.5 | ND | ND |
| K109N/A175S | 22% | 4.73E+10 | 1.3 | ND | ND |
| A175S | 52% | 8.10E+10 | 2.4 | 1.40E+04 | 0.8 |
| G318N | 37% | 5.22E+10 | 1.2 | 0.00E+00 | 0.0 |
| A122N/G124E/E394N/P395A/R396S | 46% | 1.07E+11 | 2.5 | ND | ND |

TABLE 24-continued

| Mutation (mature FVII numbering) | % Recovery (in vivo) | AUC * Activity/ Dose (TF-Dependent) | Improvement in Activity Exposure over Novo7 (TF-Dependent) | AUC * Activity/ Dose (TF-Independent) | Improvement in Activity Exposure over Novo7 (TF-Independent) |
|---|---|---|---|---|---|
| Gla SwapFIX/Q366V | 26% | 1.43E+10 | 0.5 | 1.41E+04 | 1.9 |
| Q366V | 3% | 4.09E+09 | 0.1 | 1.44E+03 | 0.1 |
| H257S | 39% | 1.67E+11 | 5.1 | 1.30E+04 | 0.9 |
| H257A | 36% | 4.96E+10 | 1.2 | 1.18E+04 | 0.6 |
| S52A/S60A/S222A | 11% | 1.05E+10 | 0.4 | 5.28E+03 | 0.7 |
| T128N/P129A/S222A | 21% | 5.28E+10 | 1.8 | 4.06E+03 | 0.6 |
| S222A | 10% | 1.55E+10 | 0.4 | 8.56E+03 | 0.5 |
| K341D | 98% | 4.77E+10 | 1.1 | ND | ND |
| S52A/S60A/Q286R | 67% | 6.42E+10 | 2.2 | 1.59E+04 | 2.2 |
| T128N/P129A/Q286R | 67% | 4.13E+11 | 14.1 | 4.24E+04 | 5.8 |
| Q286R | 35% | 1.31E+11 | 3.7 | 3.52E+04 | 2.6 |
| S52A/S60A/V158D/E296V/M298Q | 7% | 9.34E+09 | 0.3 | 8.24E+04 | 11.3 |
| T128N/P129A/V158D/E296V/M298Q | 21% | 5.03E+10 | 1.7 | 3.44E+05 | 47.4 |
| T128N/P129A/M298Q | 58% | 3.11E+10 | 1.1 | 4.49E+04 | 6.2 |
| M286Q | 18% | 1.33E+10 | 0.4 | 4.93E+04 | 3.8 |
| S52A/S60A | 51% | 5.36E+10 | 1.4 | 7.76E+03 | 0.6 |
| A51N | 15% | 4.65E+10 | 1.1 | 9.39E+03 | 0.5 |
| A122N/G124S | 45% | 5.26E+10 | 1.8 | 4.61E+03 | 0.6 |
| A122N/G124S | 45% | 9.20E+10 | 2.2 | 0.00E+00 | 0.0 |
| K109N | 52% | 1.05E+11 | 3.6 | ND | ND |
| K109N | 52% | 8.43E+10 | 2.0 | ND | ND |
| S52A | 37% | 3.50E+10 | 0.8 | 0.00E+00 | 0.0 |
| Gla Swap FIX | 31% | 2.63E+10 | 0.7 | 1.28E+04 | 1.4 |
| T128N/P129A | 88% | 8.25E+10 | 2.4 | 25147.5 | 2.6 |
| P257insGGGSCSFGRGDIRNVC | 38% | 6.29E+10 | 1.5 | ND | ND |

Example 10

Determination of Factor VIIa Binding to Soluble Tissue Factor

The ability of the FVIIa variants expressed from HEK 293 or BHK cells to bind soluble tissue factor (sTF) was assessed using Biacore surface plasmon resonance. The FVIIa variants are assessed through measurement of the binding profile at three protease concentrations in two duplicate experiments, using two different levels of sTF bound to a Biacore CM5 chip.

A new Series S CM5 sensor chip (GE Healthcare Cat #BR1006-68) was coupled with bovine serum albumin and soluble tissue factor using a Biacore T100 instrument. Coupling was carried out using a Biacore Coupling Buffer (30 mM Na Hepes pH 7.4, 135 mM NaCl, 1 mM EDTA, 0.01% Tween-20) with an Amine coupling kit (GE Healthcare Cat # BR-1000-50) and the protocol wizard in the Biacore T100 software. For the immobilization, all four cells of the chip were used. Cells 1 and 3 were coupled with 500 response units (RU) bovine serum albumin reference protein diluted in Acetate buffer, pH 4.0 and cells 2 and 4 were coupled with 500 and 250 RU of sTF (R&D Systems) diluted in Acetate buffer, pH 4.5.

Each FVIIa variant, and the wild-type FVIIa protease, was tested at three concentrations and in duplicate. The proteases were diluted to 60 nM, 30 nM and 15 nM in 100 μL Biacore Assay buffer (20 mM Na Hepes, pH 7.4, 150 mM NaCl, 5 mM $CaCl_2$, 0.1% PEG 8000, 0.1% BSA, 0.01% Tween-20) in a 96 well assay plate. Each sample was assayed in the Biacore T100 instrument using 120 seconds of contact time followed by 180 seconds of dissociation time at a 10 μL/min flow rate. A buffer blank also was assayed. The chip was regenerated with 50 mM EDTA, pH 7.0 for 60 seconds then 30 seconds. The assay to measure binding of wild-type FVIIa to sTF should yield three sets of curves that give a $K_d$ of approximately 8 nM.

Biacore T100 Evaluation software was used to analyze the data. Specifically, the Kinetics/Affinity 1:1 Binding analysis, which fits the data to the Langmuir isotherm, was utilized and the data was individually fit for two replicates of each variant at two response unit couplings. The four fit $K_d$ values were averaged and are presented in Table 25. FVIIa variants containing the M298Q mutation tended to exhibit lower $K_d$ results and thus bind more tightly to sTF.

TABLE 25

Binding of FVIIa variants to soluble TF

| | | Affinity $K_d$ (nM) | |
|---|---|---|---|
| Mutation (mature FVII numbering) | Mutation (chymotrypsin numbering) | 293-F cells | BHK cells |
| wt | wt | 7.9 | 9.0 |
| Q286N | Q143N | 8.9 | |
| Q286E | Q143E | 3.8 | |
| Q286D | Q143D | 9.8 | |
| Q286S | Q143S | 8.2 | |
| Q286T | Q143T | 10.6 | |
| Q286R | Q143R | 7.6 | |
| Q286K | Q143K | 8.2 | |
| Q286A | Q143A | 6.3 | |
| Q286V | Q143V | 11.9 | |
| S222A | S82A | 4.2 | |
| H257S | H117S | 4.2 | |
| Q366D | Q217D | 3.2 | |
| Q366E | Q217E | 5.6 | |
| Q366N | Q217N | 3.8 | |

TABLE 25-continued

Binding of FVIIa variants to soluble TF

| Mutation (mature FVII numbering) | Mutation (chymotrypsin numbering) | Affinity K$_d$ (nM) 293-F cells | BHK cells |
|---|---|---|---|
| Q366T | Q217T | 7.1 | |
| Q366S | Q217S | 9.0 | |
| Q366V | Q217V | 7.9 | |
| A175S | A39S | 6.5 | |
| V158T/L287T/M298K | V21T/L144T/M156K | 8.4 | |
| V158D/L287T/M298K | V21D/L144T/M156K | 8.5 | |
| Q286R/S222A | Q143R/S82A | | 7.3 |
| Q286R/S222A/Gla Swap FIX | Q143R/S82A/Gla swap FIX | | 8.4 |
| Q286R/M298Q | Q143R/M156Q | | 4.7 |
| Q286R/M298Q/K341Q | Q143R/M156Q/K192Q | | 11.4 |
| Q286R/M298Q/K199E | Q143R/M156Q/K60cE | | 4.9 |
| S222A/M298Q | S82A/M156Q | | 5.1 |
| H257A/M298Q | H117A/M156Q | | 3.1 |
| S222A/H257A/Q286R/M298Q | S82A/H117A/Q143R/M156Q | 2.5 | |
| Q286R/Q366V | Q143R/Q217V | 29.3 | |
| A175S/Q286R/Q366V | A39S/Q143R/Q217V | | 18.3 |
| S222A/Q286R/Q366V | S82A/Q143R/Q217V | | 8.6 |
| Q286M | Q143M | 7.1 | |
| Q286L | Q143L | 7.1 | |
| Q286Y | Q143Y | 7.5 | |
| Q366I | Q217I | 6.7 | |
| Q366L | Q217L | 5.2 | |
| Q366M | Q217M | 4.7 | |
| H216A/H257A | H76A/H117A | 6.0 | |
| Q286R/K341D | Q143R/K192D | 3.5 | |
| M298Q/K341D | Q143R/Q217D | 7.9 | |
| Q286R/Q366N | Q143R/Q217N | 8.0 | |
| Q286R/M298Q/Q366D | Q143R/M156Q/Q217D | 4.6 | |
| Q286R/M298Q/Q366N | Q143R/M156Q/Q217N | 3.8 | |

An additional set of experiments was performed to assess the binding of FVIIa variants to soluble TF using the same assay as described above, but with a modification of the FVIIa dose range to 30 nM, 15 nM and 7.5 nM and the data analysis such that a two-state model was used to fit the SPR data. This two-state model analysis was provided in the Biacore T100 Evaluation Software suite and reproduced below. The results are provided in Table 26, below.

Concentration Dependent 1:1 Binding Interaction $$\text{FVIIa} + \text{sTF} \underset{k_{-1}\,(s^{-1})}{\overset{k_1\,(M^{-1}s^{-1})}{\rightleftharpoons}} \text{FVIIa·sTF} \underset{k_{-2}\,(s^{-1})}{\overset{k_2\,(s^{-1})}{\rightleftharpoons}} \text{FVIIa·sTF*}$$

1$^{st}$ order reversible conformational change

TABLE 26

Binding of FVIIa variants to soluble TF

| Mutation (mature FVII numbering) | Mutation (chymotrypsin numbering) | Affinity K$_d$ (nM) | SD | % CV | Affinity K$_{d-WT}$/K$_{d-mut}$ | n |
|---|---|---|---|---|---|---|
| WT (NovoSeven ®) | WT (NovoSeven ®) | 6.5 | 1.2 | 19% | 1.2 | 19 |
| WT (NovoSeven-RT ®) | WT (NovoSeven-RT ®) | 6.3 | 85% | 13% | 1.2 | 4 |
| WT | WT | 7.6 | 1.9 | 24% | 1.0 | 6 |
| WT† | WT† | 3.9 | 0.6 | 15% | 1.0 | 6 |
| T128N/P129A | T[128]N/P[129]A | 6.8 | 1.2 | 18% | 1.1 | 7 |
| Gla swap FIX | Gla swap FIX | 36.0 | 2.6 | 7% | 0.2 | 3 |
| K109N | K[109]N | 10.8 | 0.2 | 2% | 0.7 | 2 |
| S52A/S60A | S[52]A/S[60]A | 23.2 | 4.0 | 17% | 0.3 | 2 |
| M298Q | M156Q | 5.9 | 0.7 | 11% | 1.3 | 4 |
| M298Q† | M156Q† | 1.9 | 0.1 | 7% | 2.0 | 2 |
| T128N/P129A/M298Q† | T[128]N/P[129]A/M156Q† | 2.4 | 0.4 | 16% | 1.6 | 2 |
| V158D/E296V/M298Q | V21D/E154V/M156Q | 2.0 | 0.5 | 26% | 3.9 | 10 |
| V158D/E296V/M298Q† | V21D/E154V/M156Q† | 1.8 | 0.5 | 30% | 2.2 | 4 |
| T128N/P129A/V158D/E296V/M298Q | T[128]N/P[129]A/V21D/E154V/M156Q | 2.0 | 0.1 | 4% | 3.9 | 2 |
| S52A/S60A/V158D/E296V/M1298Q | S[52]A/S[60]A/V21D/E154V/M156Q | 14.6 | 1.3 | 9% | 0.5 | 2 |
| Q286R | Q143R | 6.7 | 0.4 | 5% | 1.1 | 2 |
| T128N/P129A/Q286R | T[128]N/P[129]A/Q143R | 11.1 | 4.3 | 39% | 0.7 | 6 |
| T128N/P129A/Q286R† | T[128]N/P[129]A/Q143R† | 10.0 | 1.6 | 16% | 0.4 | 4 |
| S52A/S60A/Q286R | S[52]A/S[60]A/Q143R† | 51.6 | 18.4 | 36% | 0.1 | 5 |
| S222A | S82A | 2.6 | 0.1 | 4% | 3.0 | 2 |
| T128N/P129A/S222A | T[128]N/P[129]A/S82A | 3.6 | 0.2 | 7% | 2.1 | 2 |
| S52A/S60A/S222A | S[52]A/S[60]A/S82A | 17.2 | 2.4 | 14% | 0.4 | 2 |
| H257S | H117S | 6.6 | 1.5 | 23% | 1.2 | 2 |
| Gla swapFIX/Q366V | Gla swapFIX/Q217V | 56.0 | 15.1 | 27% | 0.1 | 3 |
| A175S | A39S | 12.3 | 0.1 | 1% | 0.6 | 2 |
| K109N/A175S | K[109]N/A39S | 9.0 | 0.0 | 0% | 0.8 | 2 |
| S119N/L121S/A175S | S[119]N/L[121]S/A39S | 6.6 | 0.1 | 1% | 1.1 | 2 |
| T128N/P129A/A175S | T[128]N/P[129]A/A39S | 10.0 | 0.1 | 1% | 0.8 | 2 |
| A122N/G124S/A175S | A[122]N/G[124]S/A39S | 12.1 | 2.2 | 18% | 0.6 | 2 |
| Q286R/H257A | Q143R/H117A | 7.2 | 1.0 | 13% | 1.1 | 2 |
| Q286R/H257A† | Q143R/H117A† | 5.5 | 0.1 | 2% | 0.7 | 2 |

TABLE 26-continued

Binding of FVIIa variants to soluble TF

| Mutation (mature FVII numbering) | Mutation (chymotrypsin numbering) | Affinity $K_d$ (nM) | SD | % CV | Affinity $K_{d\text{-}WT}/K_{d\text{-}mut}$ | n |
|---|---|---|---|---|---|---|
| Q286R/S222A | Q143R/S82A | 3.4 | 0.2 | 6% | 2.3 | 2 |
| Gla swap FIX/ T128N/P129A/ S222A/Q286R | Gla swap FIX/ T[128]N/P[129]A/ S82A/Q143R | 21.3 | 5.6 | 26% | 0.4 | 6 |
| Gla swap FIX/ T128N/P129A/ S222A/Q286R† | Gla swap FIX/ T[128]N/P[129]A/ S82A/Q143R† | 24.6 | 6.4 | 26% | 0.2 | 6 |
| Gla swap FIX/ S52A/S60A/S222A/Q286R | Gla swap FIX/ S[52]A/S[60]A/S82A/Q143R | 56.9 | 8.5 | 15% | 0.1 | 2 |
| Q286R/S222A/H257A | Q143R/S82A/H117A | 6.0 | 0.5 | 8% | 1.3 | 2 |
| Q286R/M298Q | Q143R/M156Q | 4.1 | 0.5 | 11% | 1.9 | 9 |
| Q286R/M298Q | Q143R/M156Q† | 3.6 | 1.1 | 29% | 1.1 | 13 |
| Q286R/M298Q | Q143R/M156Q§ | 3.2 | 0.2 | 7% | 1.2 | 4 |
| Gla swap FIX/ Q286R/M298Q | Gla swap FIX/ Q143R/M156Q | 30.4 | 5.4 | 18% | 0.3 | 3 |
| Gla swap FIX/ Q286R/M298Q† | Gla swap FIX/ Q143R/M156Q† | 22.1 | 1.5 | 7% | 0.2 | 8 |
| T128N/P129A/Q286R/ M298Q | T[128]N/P[129]A/Q143R/ M156Q | 4.7 | 1.2 | 26% | 1.6 | 5 |
| T128N/P129A/Q286R/ M298Q† | T[128]N/P[129]A/Q143R/ M156Q† | 3.9 | 0.4 | 11% | 1.0 | 8 |
| Gla swap FIX/ T128N/P129A/Q286R/ M298Q | Gla swap FIX/ T[128]N/P[129]A/Q143R/ M156Q | 20.8 | 1.4 | 7% | 0.4 | 5 |
| Gla swap FIX/ T128N/P129A/Q286R/ M298Q† | Gla swap FIX/ T[128]N/P[129]A/Q143R/ M156Q† | 37.5 | 12.3 | 33% | 0.1 | 8 |
| {Gla swap FIX/E40L}/ Q286R/M298Q | {Gla swap FIX/E[40]L}/ Q143R/M156Q | 38.5 | 7.4 | 19% | 0.2 | 2 |
| {Gla swap FIX/K43I}/ Q286R/M298Q | {Gla swap FIX/K[43]I}/ Q143R/M156Q | 35.3 | 3.4 | 10% | 0.2 | 2 |
| {Gla swap FIX/K43I}/ Q286R/M298Q† | {Gla swap FIX/K[43]I}/ Q143R/M156Q† | 23.7 | 3.6 | 15% | 0.2 | 2 |
| {Gla swap FIX/Q44S}/ Q286R/M298Q | {Gla swap FIX/Q[44]S}/ Q143R/M156Q | 40.8 | 6.4 | 16% | 0.2 | 3 |
| {Gla swap FIX/M19K}/ Q286R/M298Q | {Gla swap FIX/M[19]K}/ Q143R/M156Q | 16.7 | 2.4 | 14% | 0.5 | 2 |
| S52A/S60A/Q286R/M298Q | S[52]A/S[60]A/Q143R/M156Q | 25.1 | 1.7 | 7% | 0.3 | 3 |
| Gla swap FIX/ S52A/S60A/Q286R/M298Q† | Gla swap FIX/ S[52]A/S[60]A/Q143R/M156Q† | 6.0 | 0.1 | 1% | 0.6 | 2 |
| {Gla swap FIX/ M19K/E40L/K43I/Q44S}/ Q286R/M298Q | {Gla swap FIX/ M[19]K/E[40]L/K[43]I/Q[44]S}/ Q143R/M156Q | 4.9 | 0.1 | 1% | 1.6 | 2 |
| {Gla swap FIX/K43I}/ T128N/P129A/ Q286R/M298Q† | {Gla swap FIX/K[43]I}/ T[128]N/P[129]A/Q143R/M156Q† | 10.5 | 1.3 | 13% | 0.4 | 2 |
| T239V | T99V | 5.2 | | | 1.5 | 1 |
| T239I | T99I | 6.2 | | | 1.2 | 1 |
| T128N/P129A/S222A/ H257A/Q286R/M298Q | T[128]N/P[129]A/S82A/H117A/ Q143R/M156Q | 2.6 | 0.3 | 11% | 3.0 | 2 |
| T128N/P129A/S222A/ H257A/Q286R/M298Q† | T[128]N/P[129]A/S82A/H117A/ Q143R/M156Q† | 4.0 | 0.2 | 4% | 1.0 | 2 |
| S52A/S60A/S222A/H257A/Q286R/ M298Q | S[52]A/S[60]A/S82A/H117A/ Q143R/M156Q | 11.1 | 2.7 | 24% | 0.7 | 2 |
| T128N/P129A/Q286R/M298Q/ Q366N† | T[129]N/P[129]A/Q143R/M156Q/ Q217N† | 3.2 | 0.6 | 18% | 1.2 | 2 |
| {Gla swap FIX/K43I}/Q286R/M298Q/Q366N† | (Gla swap FIX/K[43]I}/ Q143R/M156Q/Q217N† | 13.0 | 0.7 | 5% | 0.3 | 2 |
| {Gla swap FIX/K43I}/T[128]N/P[129]A/ Q286R/M298Q/Q366N† | {Gla swap FIX/K[43]I}/ T[128]N/P[129]A/Q143R/M156Q/ Q217N† | 13.1 | 0.3 | 2% | 0.3 | 2 |
| T128N/P129A/Q286R/H373F | T[128]N/P[129]A/Q143R/H224F | 6.8 | 0.0 | 0% | 1.1 | 2 |
| T128N/P129A/Q286R/M298Q/ H373F | T[128]N/P[129]A/Q143R/M156Q/ H224F | 3.1 | 0.1 | 4% | 2.4 | 2 |
| S52A/S60A/Q286R/M298Q/ H373F | S[52]A/S[60]A/Q143R/M156Q/ H224F | 23.4 | 7.5 | 32% | 0.3 | 3 |
| T128N/P129A/M298Q/H373F† | T[128]N/P[129]A/M156Q/H224F† | 1.3 | 0.5 | 41% | 3.1 | 2 |
| V21D/Q143R/E154V/M156Q | V21D/Q143R/E154V/M156Q | 2.2 | 0.2 | 8% | 3.5 | 2 |
| Gla swap FIX/ S222A/T239V/Q286R | Gla swap FIX/ S82A/T99V/Q143R | 19.1 | 7.7 | 40% | 0.4 | 7 |
| Gla swap FIX/ S222A/T239V/Q286R† | Gla swap FIX/ S82A/T99V/Q143R† | 14.9 | 0.4 | 3% | 0.3 | 2 |

TABLE 26-continued

Binding of FVIIa variants to soluble TF

| Mutation (mature FVII numbering) | Mutation (chymotrypsin numbering) | Affinity $K_d$ (nM) | SD | % CV | Affinity $K_{d\text{-}WT}/K_{d\text{-}mut}$ | n |
|---|---|---|---|---|---|---|
| T239V/Q286R/M298Q | T99V/Q143R/M156Q | 2.5 | 0.1 | 4% | 3.1 | 2 |
| Gla swap FIX/ T239V/Q286R/M298Q | Gla swap FIX/ T99V/Q143R/M156Q | 22.7 | 6.8 | 30% | 0.3 | 6 |
| Gla swap FIX/ T239V/Q286R/M298Q† | Gla swap FIX/ T99V/Q143R/M156Q† | 25.7 | 9.2 | 36% | 0.2 | 6 |
| T128N/P129A/T239V/Q286R/ M298Q† | T[128]N/P[129]A/ T99V/Q143R/M156Q† | 7.8 | 0.6 | 8% | 0.5 | 2 |
| S222A/T239V/H257A/ Q286R/M298Q | S82A/T99V/H117A/Q143R/ M156Q | 2.2 | 0.0 | 2% | 3.4 | 2 |
| T128N/P129A/S222A/T239V/ H257A/Q286R/M298Q† | [T128]N/P[129A]/S82A/T99V/ H117A/Q143R/M156Q† | 3.6 | 0.7 | 18% | 1.1 | 2 |
| T128N/P129A/T239V/Q286R/ M298Q/H373F† | T[128N]/P129]A/T99V/Q143R/ M156Q/H224F† | 3.9 | 0.1 | 3% | 1.0 | 2 |
| T239I/Q286R | T99I/Q143R | 8.0 | 0.2 | 3% | 1.0 | 2 |
| GlaSwapFIX/S222A/T239I/Q286R | Gla swap FIX/ S82A/T99I/Q143R | 39.6 | 1.2 | 3% | 0.2 | 2 |
| Gla swap FIX/ T239I/Q286R/M298Q | Gla swap FIX/ T99I/Q143R/M156Q | 13.1 | 2.1 | 16% | 0.6 | 2 |
| T128N/P129A/T239I/Q286R/ M298Q† | [T128]N/P[129A]/ T99I/Q143R/M156Q† | 5.1 | 0.9 | 18% | 0.8 | 2 |
| T239I/Q286R/H373F | T99I/Q143R/H224F | 7.8 | 0.1 | 1% | 1.0 | 2 |
| V158D/T239V/E296V/M298Q | V21D/T99V/E154V/M156Q | 1.7 | 0.6 | 32% | 4.4 | 4 |
| V158D/T239V/E296V/M298Q† | V21D/T99V/E154V/M156Q† | 1.9 | 0.7 | 36% | 2.1 | 4 |
| T239V/Q286R | T99V/Q143R | 2.3 | 0.0 | 1% | 1.7 | 2 |
| T128N/P129A/T239I/ Q286R/M298Q/H237F† | T[128]N/P[129]A/T99I/ Q143R/M156Q/H224F† | 3.4 | 0.0 | 0% | 1.2 | 2 |
| Gla swap FIX/ Q286R/S222A/H257S | Gla swap FIX/ Q143R/S82A/H117S | 34.3 | 9.1 | 27% | 0.2 | 3 |
| S222A/Q286R/M298Q/ H373F | S82A/Q143R/M156Q/H224F | 2.1 | 0.1 | 6% | 3.7 | 2 |
| Gla swap FIX/S222A/ Q286R/M298Q/H373F | Gla swap FIX S82A/Q143R/M156Q/H224F | 9.5 | 0.9 | 9% | 0.8 | 2 |
| T128N/P129A/A175S/ Q366V | T[128]N/P[129]A/A39S/Q217V | 6.5 | 12.0 | 184% | 1.2 | 2 |
| A122N/G124S/A175S/ Q366V | A[122]N/G[124]S/A39S/Q217V | 13.0 | 0.6 | 5% | 0.6 | 2 |
| T128N/P129A/A175S/ S222A | T[128]N/P[129]A/A39S/S82A | 4.5 | 0.3 | 7% | 1.7 | 2 |
| A122N/G124S/A175S/ S222A | A[122]N/G[124]S/A39S/S82A | 7.0 | 0.6 | 9% | 1.1 | 2 |
| T128N/P129A/A175S/ Q286R | T[128]N/P[129]A/A39S/Q143R | 8.6 | 0.1 | 1% | 0.9 | 2 |
| A122N/G124S/A175S/ Q286R | A[122]N/G[124]S/A39S/Q143R | 8.6 | 0.0 | 0% | 0.9 | 2 |
| Gla swap FIX/ S222A/Q286R/H373F | Gla swap FIX/ S82A/Q143R/H224F | 40.9 | 7.5 | 18% | 0.2 | 3 |
| Gla swap FIX/ A122N/G124S/A175S/ S222A/Q286R | Gla swap FIX/ A[122]N/G[124]S/A39S/S82A/ Q143R | 43.7 | 14.0 | 32% | 0.2 | 2 |
| T128N/P129A/A175S/ Q286R/M298Q | T[128]N/P[129]A/A39S/Q143R/ M156Q | 5.5 | 0.0 | 0% | 1.4 | 2 |
| A122N/G124S/A175S/ Q286R/M298Q | A[122]N/G[124]S/A39S/Q143R/ M156Q | 5.3 | 0.1 | 2% | 1.4 | 2 |
| T128N/P129A/A175S/ S222A/H257A/Q286R/ M298Q | T[128]N/P[129]A/A39S/S82A/ H117A/Q143R/M156Q | 6.7 | 0.8 | 11% | 1.1 | 2 |
| A122N/G124S/A175S/ S222A/H257A/Q286R/ M298Q | A[122]N/G[124]S/A39S/S82A/ H117A/Q143R/M156Q | 7.7 | 0.6 | 8% | 1.0 | 2 |
| T128N/P129A/A175S/ Q286R/M298Q/H373F | T[128]N/P[129]A/A39S/Q143R/ M156Q/H224F | 7.4 | 3.2 | 43% | 1.0 | 2 |
| A122N/G124S/A175S/ Q286R/M298Q/H373F | A[122]N/G[124]S/A39S/Q143R/ M156Q/H224F | 5.0 | 0.1 | 3% | 1.5 | 2 |
| V158D/Q286R/E296V/M298Q/ H373F | V21D/Q143R/E154V/M156Q/ H224F | 1.7 | 0.5 | 27% | 4.5 | 3 |
| M298Q/Q366N/H373F† | M156Q/Q217N/H224F† | 1.6 | 0.9 | 60% | 2.5 | 4 |
| T239V/M298Q/H373F† | T99V/M156Q/H224F† | 3.5 | 0.4 | 11% | 1.1 | 2 |
| T239I/M298Q/H373F† | T99I/M156Q/H224F | 2.3 | 0.6 | 24% | 1.7 | 4 |
| T128N/P129A/Q286R/ M298Q/Q366N/H373F† | T[128]N/P[129]A/Q143R/ M156Q/Q217N/H224F† | 2.6 | 0.6 | 23% | 1.5 | 2 |

TABLE 26-continued

Binding of FVIIa variants to soluble TF

| Mutation (mature FVII numbering) | Mutation (chymotrypsin numbering) | Affinity $K_d$ (nM) | SD | % CV | Affinity $K_{d\text{-}WT}$/ $K_{d\text{-}mut}$ | n |
|---|---|---|---|---|---|---|
| T239V/Q286R/M298Q/ Q366N† | T99V/Q143R/M156Q/ Q217N† | 4.1 | 0.3 | 8% | 0.9 | 2 |
| T239I/Q286R/M298Q/Q366N† | T99I/Q143R/M156Q/Q217N† | 2.4 | 0.6 | 27% | 1.6 | 2 |

†produced in CHOX cells
§produced in CHOX stable cell line clone 52-5F7

Example 11

Inhibition of FVIIa Variants by $Zn^{2+}$

FVIIa variants, expressed from HEK 293 or BHK cells, were assayed for resistance to inhibition by $Zn^{2+}$ both in the presence or absence of soluble tissue factor. Briefly, $ZnCl_2$ (Aldrich) was diluted to 20 mM in $dH_2O$ then to 4 mM in 1× assay buffer (50 mM Na Hepes, pH 7.5, 100 mM NaCl, 1.5 mM $CaCl_2$, 0.01% Tween-20 and 0.01% PEG-8000). Serial 2 fold dilutions were made to generate eleven concentrations of zinc, down to 3.9 µM, across a 96 well plate. The last well in the row contained buffer with no zinc to measure uninhibited FVIIa proteolytic activity. The FVIIa variants, and the wild-type protease, was diluted to 500 nM then again 10 fold to 50 nM. This 50 nM stock solution was used for assays performed without soluble tissue factor (sTF, R&D Systems). For assays with soluble tissue factor, the protease was diluted again in 1× assay buffer with sTF to final concentrations of 12.5 nM and 125 nM, respectively. The solutions were preincubated for at least 5 minutes at room temperature.

To start the inhibition reaction, 20 µL of the FVIIa/sTF or FVIIa solution was mixed with 60 µL of the zinc series to each row for ten concentrations. For inhibition reactions with FVIIa alone, the mixtures were started using 2 mM $ZnCl_2$, and for FVIIa/sTF, they were started using 4 mM $ZnCl_2$. The plate was incubated for 30 minutes at room temperature. To assay the $Zn^{2+}$ inhibition, 20 µL FVIIa substrate (Mesyl-dFPR-ACC, dissolved to 20 mM in DMSO and diluted in assay buffer) was added to the wells to a final concentration of 90 µM. The sTF and zinc concentrations were maintained in the assay by adding them as appropriate to the substrate solution. The fluorescence increase (Ex: 380 nm, Em: 460 nm) was measured for 60 minutes at 30° C. on a Spectramax Gemini M5 (Molecular Devices) plate reader. The residual proteolytic activity was calculated at every concentration of zinc by dividing the inhibited rate by the uninhibited protease rate. The $Zn^{2+}$ concentration necessary to inhibit half of the proteolytic activity ($K_{0.5}$) was calculated by plotting the concentration of zinc versus the residual activity, and fitting with a hyperbolic equation using XLFit4 software (IDBS). Each protease was assayed twice on two separate occasions to obtain an average value for the $K_{0.5}$.

The results are provided in Table 27. The H257 and H216 mutations increased resistance by approximately 3 fold. M268Q mutations also increased resistance to zinc by 3 fold. In all cases, the effect was retained to differing degrees when combined with additional mutations. The most resistant variants were combinations of the above mutations: H216A/H257A-FVIIa and H257A/M298Q-FVIIa.

TABLE 27

Inhibition of FVIIa variants by $Zn^{2+}$

| Mutation (mature FVII numbering) | Mutation (chymotrypsin numbering) | $K_{0.5}$ (mM) HEK 293 | BHK |
|---|---|---|---|
| WT | WT | 87.0 | 42.0 |
| M298Q | M156Q | 187.3 | |
| Q286R | Q143R | 30.1 | 22.5 |
| H216S | H76S | 231.0 | |
| H216A | H76A | 244.5 | |
| H216K | H76K | 248.8 | |
| H216R | H76R | 316.5 | |
| S222A | S82A | 87.5 | 63.8 |
| S222K | S82K | 73.0 | |
| H257A | H117A | 217.5 | 113.0 |
| H257S | H117S | 149.7 | 128.0 |
| K161S | K24S | 51.5 | |
| K161A | K24A | 73.5 | |
| K161V | K24V | 79.5 | |
| Q286R/S222A | S82A/Q143R | | 24.5 |
| Q286R/S222A/Gla Swap FIX | S82A/Q143R/glaswapFIX | 34.0 | |
| S222A/M298Q | S82A/M156Q | 138.0 | |
| H257A/M298Q | H117A/M156Q | 481.0 | |
| S222A/H257A/Q286R/ M298Q | S82A/H117A/Q143R/M156Q | 180.6 | |
| S222A/Q286R/Q366V | S82A/Q143R/Q217V | 40.5 | |
| S222V | S82V | 86.8 | |
| S222D | S82D | 89.5 | |
| S222N | S82N | 94.6 | |
| S222E | S82E | 110.5 | |
| H216A/H257A | H76A/H117A | 407.5 | |
| H216A/S222A | H76A/S82A | 226.0 | |
| H257S/Q286R | H117S/Q143R | 316.5 | |
| S222A/H373A | S82A/H224A | 94.0 | |

Example 12

Determination of the Concentration of Catalytically Active Protease Using the Active Site Titrant 4-methylumbelliferyl p'-guanidinobenzoate (MUGB)

In some instances, the concentration of catalytically active FVIIa in a stock solution was determined by titrating a complex FVIIa and soluble tissue factor (sTF) with 4-methylumbelliferyl p'-guanidinobenzoate (MUGB), a fluorogenic ester substrate developed as an active site for trypsin-like serine proteases. The assay was carried out essentially as described by Payne et al. (Biochemistry (1996) 35:7100-7106) with a few minor modifications. MUGB readily reacts with FVIIa, but not FVII or inactive protease, to form an effectively stable acyl-enzyme intermediate under conditions in which the concentration of MUGB is saturating and deacylation is especially slow and rate limiting for catalysis. Under these conditions, the FVIIa protease undergoes a single catalytic turnover to release the 4-methylumbelliferone fluorophore (4-MU). When the initial burst of fluorescence is calibrated to an external concentration standard curve of 4-MU fluorescence, the concentration of active sites may be calculated.

Assays were performed with a 1 mL or 2 mL reaction volume in a 0.4 cm×1 cm or 1 cm×1 cm quartz cuvettes, respectively, under continuous stirring. Each reaction contained 0.5 µM sTF (R&D Systems Human) in an assay buffer containing 50 mM Hepes, 100 mM NaCl, 5 mM CaCl$_2$ and 0.1% PEG 8000, pH 7.6. The 4-MU standard solution was freshly prepared at a stock concentration of 0.5 M in DMSO and the concentration confirmed by absorbance spectroscopy at 360 nm using an extinction coefficient of 19,000 M$^{-1}$cm$^{-1}$ in 50 mM Tris buffer, pH 9.0. MUGB was prepared at a stock concentration of 0.04 M in DMSO based on the dry weight. Assays were initiated by adding 4 µL of 4 mM MUGB (for the 2.0 mL reaction) or 2 mM MUGB (for the 1.0 mL reaction) (in each case a 8 µM final concentration) to a solution of 0.5 µM sTF (20.2 µL or 10.1 µL of 49.4 µM sTF) in 1× assay buffer and first measuring the background hydrolysis of MUGB for ~150-200 seconds before the addition of FVIIa or FVIIa variant to a final concentration of ~100-200 nM based on the initial ELISA (Example 1C.1) or the active site titration with FFR-CMK (Example 3). The release of 4-MU fluorescence in the burst phase of the reaction was followed for an additional 1000-1200 seconds. A standard curve of free 4-MU was prepared by titration of the absorbance-calibrated 4-MU into 1× assay buffer containing 0.5 µM sTF in 20 nM steps to a final concentration of 260-300 nM.

For data analysis, reaction traces were imported into the Graphpad Prism software package and the contribution of background hydrolysis was subtracted from the curve by extrapolation of the initial measured rate of spontaneous MUGB hydrolysis, which was typically less than 5% of the total fluorescence burst. The corrected curve was fit to a single exponential equation with a linear component (to account for the slow rate of deacylation) of the form ΔFluorescence=Amp $(1-e^{-kt})$+Bt, where Amp=the amplitude of the burst phase under the saturating assay conditions outline above, k is the observed first order rate constant for acyl-enzyme formation and B is a bulk rate constant associated with complete turnover of MUGB. The concentration of active FVIIa protease is calculated by comparison of the fit parameter for amplitude to the 4-MU standard curve. The values from multiple assays were measured, averaged and the standard deviation determined.

Example 13

Specific Activity of FVIIa Variant Polypeptides for Mesyl-dFPR-ACC

To assess the activity of FVIIa variants, the activity (activity/mole) of FVIIa polypeptides for cleavage of a tripeptide ACC substrate (Mesyl-dFPR-ACC) under a set of standardized assay conditions was determined. The assay involved a preincubation of FVIIa polypeptides with a saturating amount of sTF prior to dilution into the mesyl-dFPR-ACC substrate. The initial rates of substrate cleavage were then followed by assessing the increase in ACC fluorescence. Initial rates of fluorescence release were normalized to an internal ACC standard curve and the data was reported as µmol/sec/µmol FVIIa.

To prepare the reactions, each FVIIa sample to be tested was diluted in a polypropylene storage plate to 200 nM in 1× assay buffer (20 mM Hepes, 150 mM NaCl, 5 mM CaCl$_2$, 0.1% BSA, 0.1% PEG-8000, pH 7.5). Where necessary, a 1:10 dilution of the stock FVIIa was prepared so that the minimum pipetted volume was 5 µL. A dilution of stock soluble tissue factor (sTF) (R&D Systems) was prepared to a final concentration of 1.0 µM with an appropriate volume of 1× assay buffer necessary to account for the screening of 8 to 32 proteases/plate. For instance, when assaying 8 proteases, 1.0 mL of 1.0 µM sTF was required/plate, whereas for assaying 32 proteases, 2.5 mL of sTF was required/plate. The FVIIa samples were complexed with sTF at a final concentration of 100 nM FVIIa/500 nM sTF in a 50 µL assay volume by mixing 25 µL of 200 nM FVIIa variant with 25 µL of 1.0 µM sTF in the polypropylene storage plate. The FVIIa/sTF complex reactions were then incubated at room temperature for 15 minutes to reach equilibrium. Following the equilibration period, 10 µL of each FVIIa/sTF complex reaction was dispensed into the corresponding row of a 96-well half area black assay plate (Costar). The FVIIa variants and controls were assayed in triplicate. The mesyl-dFPR-ACC substrate was prepared to 1.1× the final concentration of 0.09 mM to account for the 1:10 dilution of the FVIIa polypeptide into substrate. For an entire 96-well half area plate, 20 mL of 0.1 mM mesyl-dFPR-ACC substrate was prepared in 1× assay buffer by dilution of the stock substrate stored in dry DMSO.

The assay was run on a BioMek® FX automated workstation (Beckman Coulter) equipped with a 96-tip head (MBP BioRobotix ART® 130 µL tips). The assay plate (pre-dispensed with 10 µL of the FVIIa/sTF reactions) was placed on the deck of the workstation with a single-channel reservoir filled with the 1.1× mesyl-dFPR-ACC solution. The temperature of the plate reader was set to 37° C. The BioMek® FX workstation initiated the assay by transferring 90 µL from the single-channel reservoir filled with 1.1× mesyl-dFPR-ACC substrate into each well of the black assay plate containing 10 µL of FVIIa/sTF. The final concentrations of the FVIIa variants, sTF and Mesyl-dFPR-ACC concentration in the assay were 10 nM, 50 nM and 0.09 mM, respectively. The workstation then mixed 70 µL of the 100 µL sample twice. The black assay plate was transferred into a SpectraMax Gemini plate reader (Molecular Devices) and the initial reaction rates were followed for 10 min at 37° C.

Following completion of the assay, a plate containing a standard curve of free ACC (100 µL/well) was read on the same SpectraMax Gemini plate reader and used to provide an accurate conversion of RFU/sec to µM/sec. The standard plate was prepared as follows. In all the "even-numbered" wells (i.e. every second well) of the top row of a 96-well black half-area assay plate, the 1 mM ACC sample was diluted to 25 nM in 1× Assay Buffer to a final volume 200 µL (5 µL 1 mM ACC in 195 µL 1× Assay Buffer). One hundred µL of 1× Assay Buffer was pipetted into all of the remaining wells of the "even-numbered" columns. The ACC substrate was serially diluted 1:1 down the even columns to generate 6 more ACC concentrations. The last row was left with only 100 µL 1× Assay Buffer (i.e. without ACC). The fluorescence was measured using an endpoint-reading version of the assay conditions and a graph of fluorescence versus concentration of ACC was plotted. The slope of the line through these points gave the conversion factor from RFU to µM.

SoftMax Pro software (Molecular Devices) was used to analyze the data for the plate read as well as the standard curve. The file containing the data was saved and exported as an ASCII text file, which was imported into the Microsoft Excel program, processed and analyzed using a template created in Microsoft Excel. Upon importing the data into the Microsoft Excel template, the average RFU/µM conversion was calculated from the slope of the ACC standard curve and used to provide a conversion factor that changed the plate data from RFU/sec to the activity measurement in µM/sec. All triplicate values were evaluated for outliers, which were excluded if necessary. The specific activity of each FVIIa variant and wild type controls were expressed in the units of µmol/sec/µmol, and calculated by the following expressions:

Average data (RFU/sec)*conversion factor (RFU/µM)= Activity (in µM/sec)

Specific Activity (in µmol/sec/µmol)=[(µM/sec)* (100 µL)*(1/1000000)]/[(10 nM)*(100 µL)* (1/1000000)*(1/1000)]

Table 28 sets forth the specific activity the FVIIa variants that were assayed, including the activity relative to the wild-type FVIIa. Also included are the standard deviation (SD) and coefficient of variation (as a percentage; % CV). Several FVIIa variants exhibited increased specific activity for cleavage of Mesyl-dFPR-ACC compared to the wild-type FVIIa polypeptide. For example, Q366V-FVIIa exhibited specific activity for cleavage of Mesyl-dFPR-ACC that was 4 times greater than that observed with the wild-type FVIIa variant. FVIIa variants containing the H373F mutation also tended to exhibit increased specific activity for cleavage of Mesyl-dFPR-ACC compared to the wild-type FVIIa polypeptide.

TABLE 28

Specific Activity of FVIIa polypeptides for mesyl-dFPR-ACC

| Mutation (mature FVII numbering) | Mutation (Chymotrypsin numbering) | Activity (µmol/sec/µmol) | SD | % CV | Activity (% WT) | n |
|---|---|---|---|---|---|---|
| WT (NovoSeven ®) | WT (NovoSeven ®) | 2.31 | 0.34 | 0.15 | 100% | 3 |
| WT | WT | 2.40 | 0.15 | 0.06 | 104% | 4 |
| T128N/P129A | T[128]N/P[129]A | 2.50 | | | 108% | 1 |
| Gla swap FIX | Gla swap FIX | 1.63 | | | 71% | 1 |
| A122N/G124S | A[122]N/G[124]S | 2.24 | | | 97% | 1 |
| S52A/S60A | S[52]A/S[60]A | 1.95 | | | 85% | 1 |
| V158D/E296V/M298Q | V21D/E154V/M156Q | 3.28 | | | 142% | 1 |
| T128N/P129A/V158D/ E296V/M298Q | T[128]N/P[129]A/V21D/ E154V/M156Q | 3.26 | | | 142% | 1 |
| S52A/S60A/V158D/ E296V/M298Q | S[52]A/S[60]A/V21D/ E154V/M156Q | 2.56 | | | 111% | 1 |
| Q286R | Q143R | 1.24 | | | 54% | 1 |
| T128N/P129A/Q286R | T[128]N/P[129]A/Q143R | 1.21 | | | 52% | 1 |
| S52A/S60A/Q286R | S[52]A/S[60]A/Q143R | 0.44 | 0.11 | 0.25 | 19% | 2 |
| S222A | S82A | 2.35 | | | 102% | 1 |
| T128N/P129A/S222A | T[128]N/P[129]A/S82A | 2.70 | | | 117% | 1 |
| S52A/S60A/S222A | S[52]A/S[60]A/S82A | 1.22 | | | 53% | 1 |
| H257S | H117S | 2.64 | | | 115% | 1 |
| H373F | H224F | 1.17 | | | 51% | 1 |
| Q366V | Q217V | 9.29 | | | 403% | 1 |
| Gla swapFIX/Q366V | Gla swapFIX/Q217V | 2.82 | | | 122% | 1 |
| K109N/A175S | K[109]N/A39S | 3.38 | | | 147% | 1 |
| Q286R/H257A | Q143R/H117A | 1.96 | | | 85% | 1 |
| Gla swap FIX/ T128N/P129A/ S222A/Q286R | Gla swap FIX/ T[128]N/P[129]A/ S82A/Q143R | 0.53 | | | 23% | 1 |
| Gla swap FIX/ S52A/S60A/S222A/ Q286R | Gla swap FIX/ S[52]A/S[60]A/S82A/ Q143R | 0.44 | 0.42 | 0.96 | 19% | 2 |
| Q286R/M298Q | Q143R/M156Q | 1.91 | 0.11 | 0.06 | 83% | 5 |
| Gla swap FIX/ Q286R/M298Q | Gla swap FIX/ Q143R/M156Q | 1.53 | | | 66% | 1 |
| T128N/P129A/Q286R/ M298Q | T[128]N/P[129]A/Q143R/ M156Q | 1.80 | | | 78% | 1 |
| Gla swap FIX/ T128N/P129A/Q286R/ M298Q | Gla swap FIX/ T[128]N/P[129]A/Q143R/ M156Q | 0.78 | | | 34% | 1 |
| {Gla swap FIX/E40L}/ Q286R/M298Q | {Gla swap FIX/E[40]L}/ Q143R/M156Q | 1.16 | | | 50% | 1 |
| {Gla swap FIX/K43I}/ Q286R/M298Q | {Gla swap FIX/K[43]I}/ Q143R/M156Q | 1.20 | | | 52% | 1 |
| {Gla swap FIX/Q44S}/ Q286R/M298Q | {Gla swap FIX/Q[44]S}/ Q143R/M156Q | 1.11 | | | 48% | 1 |
| {Gla swap FIX/M19K}/ Q286R/M298Q | {Gla swap FIX/M[19]K}/ Q143R/M156Q | 1.26 | | | 55% | 1 |
| S52A/S60A/ Q286R/M298Q | S[52]A/S[60]A/Q143R/ M156Q | 1.08 | 0.17 | 0.15 | 47% | 2 |
| T128N/P129A/S222A/ H257A/Q286R/M298Q | T[128]N/P[129]A/S82A/ H117A/Q143R/M156Q | 1.66 | | | 72% | 1 |
| S52A/S60A/S222A/ H257A/Q286R/M298Q | S[52]A/S[60]A/S82A/H117A/ Q143R/M156Q | 0.98 | | | 42% | 1 |
| H257S/Q286R/Q366V | H117S/Q143R/Q217V | 2.00 | 0.17 | 0.08 | 87% | 2 |
| S222A/H257A/Q286R/ Q366V | S82A/H117A/Q143R/ Q217V | 2.43 | | | 105% | 1 |
| Q286R/M298Q/Q366N | Q143R/M156Q/Q217N | 2.35 | | | 102% | 1 |
| Q286R/H373F | Q143R/H224F | 0.78 | | | 34% | 1 |
| T128N/P129A/ Q286R/H373F | T[128]N/P[129]A/Q143R/ H224F | 2.31 | | | 100% | 1 |
| S52A/S60A/ Q286R/H373F | S[52]A/S[60]A/Q143R/ H224F | 3.14 | | | 136% | 1 |

TABLE 28-continued

Specific Activity of FVIIa polypeptides for mesyl-dFPR-ACC

| Mutation (mature FVII numbering) | Mutation (Chymotrypsin numbering) | Activity (μmol/sec/μmol) | SD | % CV | Activity (% WT) | n |
|---|---|---|---|---|---|---|
| Q286R/M298Q/H373F | Q143R/M156Q/H224F | 4.59 | | | 199% | 1 |
| T128N/P129A/Q286R/M298Q/H373F | T[128]N/P[129]A/Q143R/M156Q/H224F | 2.83 | | | 123% | 1 |
| S52A/S60A/Q286R/M298Q/H373F | S[52]A/S[60]A/Q143R/M156Q/H224F | 5.02 | | | 218% | 1 |
| M298Q/H373F | M156Q/H224F | 4.00 | | | 174% | 1 |
| V21D/Q143R/E154V/M156Q | V21D/Q143R/E154V/M156Q | 1.83 | | | 79% | 1 |
| S222A/T239V | S82A/T99V | 1.91 | | | 83% | 1 |
| Gla swap FIX/S222A/T239V/Q286R | Gla swap FIX/S82A/T99V/Q143R | 0.66 | | | 28% | 1 |
| T239V/Q286R/M298Q | T99V/Q143R/M156Q | 1.74 | | | 75% | 1 |
| Gla swap FIX/T239V/Q286R/M298Q | Gla swap FIX/T99V/Q143R/M156Q | 1.13 | | | 49% | 1 |
| S222A/T239V/H257A/Q286R/M298Q | S82A/T99V/H117A/Q143R/M156Q | 1.66 | | | 72% | 1 |
| T239V/Q286R/H373F | T99V/Q143R/H224F | 1.53 | | | 66% | 1 |
| T239V/Q286R/M298Q/H373F | T99V/Q143R/M156Q/H224F | 3.07 | | | 133% | 1 |
| V158D/T239I/E296V/M298Q | V21D/T99I/E154V/M156Q | 2.24 | | | 97% | 1 |
| T239I/Q286R | T99I/Q143R | 0.88 | | | 38% | 1 |
| S222A/T239I | S82A/T99I | 1.36 | | | 59% | 1 |
| GlaSwapFIX/S222A/T239I/Q286R | Gla swap FIX/S82A/T99I/Q143R | 0.25 | | | 11% | 1 |
| T239I/Q286R/M298Q | T99I/Q143R/M156Q | 1.37 | | | 60% | 1 |
| Gla swap FIX/T239I/Q286R/M298Q | Gla swap FIX/T99I/Q143R/M156Q | 0.67 | | | 29% | 1 |
| S222A/T239I/H257A/Q286R/M298Q | S82A/T99I/H117A/Q143R/M156Q | 1.41 | | | 61% | 1 |
| T239I/Q286R/H373F | T99I/Q143R/H224F | 1.24 | | | 54% | 1 |
| V158D/T239V/E296V/M298Q | V21D/T99V/E154V/M156Q | 2.19 | 0.15 | 0.07 | 95% | 3 |
| T239V/Q286R | T99V/Q143R | 1.26 | 0.14 | 0.11 | 55% | 2 |
| T239I/Q286R/M298Q/H237F | T99I/Q143R/M156Q/H224F | 1.59 | 0.21 | 0.13 | 69% | 3 |
| H257S/Q286R/M298Q | H117S/Q143R/M156Q | 1.85 | 0.23 | 0.13 | 80% | 2 |
| Gla swap FIX/Q286R/S222A/H257S | Gla swap FIX/Q143R/S82A/H117S | 0.49 | 0.04 | 0.09 | 21% | 2 |
| S222A/H257S/Q286R/M298Q | S82A/H117S/Q143R/M156Q | 1.77 | 0.23 | 0.13 | 77% | 2 |
| H257S/Q286R/M298Q/H373F | H117S/Q143R/M156Q/H224F | 2.32 | 0.41 | 0.18 | 101% | 3 |
| S222A/Q286R/M298Q/H373F | S82A/Q143R/M156Q/H224F | 2.79 | 0.39 | 0.14 | 121% | 2 |
| Gla swap FIX/S222A/Q286R/M298Q/H373F | Gla swap FIX/S82A/Q143R/M156Q/H224F | 1.92 | | | 83% | 1 |
| S222A/Q286R/M298Q | S82A/Q143R/M156Q | 1.90 | | | 82% | 1 |
| Gla swap FIX/S222A/Q286R/M298Q | Gla swap FIX/S82A/Q143R/M156Q | 1.12 | | | 49% | 1 |
| T128N/P129A/A175S/Q366V | T[128]N/P[129]A/A39S/Q217V | 3.40 | | | 148% | 1 |
| A122N/G124S/A175S/Q366V | A[122]N/G[124]S/A39S/Q217V | 2.34 | 0.22 | 0.09 | 101% | 2 |
| T128N/P129A/A175S/S222A | T[128]N/P[129]A/A39S/S82A | 3.19 | | | 138% | 1 |
| A122N/G124S/A175S/S222A | A[122]N/G[124]S/A39S/S82A | 2.68 | 0.30 | 0.11 | 116% | 2 |
| T128N/P129A/A175S/Q286R | T[128]N/P[129]A/A39S/Q143R | 1.88 | | | 81% | 1 |
| A122N/G124S/A175S/Q286R | A[122]N/G[124]S/A39S/Q143R | 2.16 | 0.42 | 0.20 | 94% | 2 |
| Gla swap FIX/S222A/Q286R/H373F | Gla swap FIX/S82A/Q143R/H224F | 1.37 | 0.26 | 0.19 | 60% | 2 |
| V158D/E296V/M298Q/H373F | V21D/E154V/M156Q/H224F | 5.60 | | | 243% | 1 |
| H257A/Q286R/M298Q | H117A/Q143R/M156Q | 2.18 | | | 95% | 1 |
| Gla swap FIX/T128N/P129A/A175S/S222A/Q286R | Gla swap FIX/T[128]N/P[129]A/A39S/S82A/Q143R | 0.75 | | | 32% | 1 |
| Gla swap FIX/A122N/G124S/A175S/S222A/Q286R | Gla swap FIX/A[122]N/G[124]S/A39S/S82A/Q143R | 0.89 | | | 38% | 1 |
| T128N/P129A/A175S/Q286R/M298Q | T[128]N/P[129]A/A39S/Q143R/M156Q | 2.02 | | | 88% | 1 |

TABLE 28-continued

Specific Activity of FVIIa polypeptides for mesyl-dFPR-ACC

| Mutation (mature FVII numbering) | Mutation (Chymotrypsin numbering) | Activity (μmol/sec/μmol) | SD | % CV | Activity (% WT) | n |
|---|---|---|---|---|---|---|
| A122N/G124S/A175S/ Q286R/M298Q | A[122]N/G[124]S/A39S/Q143R/ M156Q | 3.03 | | | 131% | 1 |
| T128N/P129A/A175S/ S222A/H257A/Q286R/ M298Q | T[128]N/P[129]A/A39S/S824A/ H117A/Q143R/M156Q | 21.8 | | | 95% | 1 |
| A122N/G124S/A175S/ S222A/H257A/Q286R/ M298Q | A[122]N/G[124]S/A39S/S82A/ H117A/Q143R/M156Q | 1.99 | | | 86% | 1 |
| T128N/P129A/A175S/ Q286R/M298Q/H373F | T[128]N/P[129]A/A39S/Q143R/ M156Q/H224F | 2.78 | | | 121% | 1 |
| A122N/G124S/A175S/ Q286R/M298Q/H373F | A[122]N/G[124]S/A39S/Q143R/ M156Q/H224F | 2.71 | | | 118% | 1 |
| V158D/Q286R/E296V/M298Q/ H373F | V21D/Q143R/E154V/M156Q/ H224F | 1.89 | | | 82% | 1 |

Example 15

Activation of FX and Determination of the Concentration of Catalytically Active Protease Using the Active Site Titrant Fluorescein-mono-p'-guanidinobenzoate (FMGB)

The concentration of Factor X (FX), which is able to become catalytically active, in a stock solution of the zymogen was determined by activation of FX samples with Russell's Viper Venom (RVV-ase) followed by titrating the active Factor X (FXa) with fluorescein-mono-p'-guanidinobenzoate (FMGB), a fluorogenic ester substrate developed as an active site titrant for trypsin-like serine proteases. Following activation, the active site titration assay was carried out essentially as described by Bock et al. (Archives of Biochemistry and Biophysics (1989) 273:375-388) with a few minor modifications. FMGB readily reacts with FXa, but not FX or inactive protease, to form an effectively stable acyl-enzyme intermediate under conditions in which the concentration of FMGB is saturating and deacylation is especially slow and rate limiting for catalysis. Under these conditions, the FXa protease undergoes a single catalytic turnover to release the fluorescein fluorophore. When the initial burst of fluorescence is calibrated to an external concentration standard curve of fluorescein fluorescence, the concentration of active sites can be calculated.

FXa activation reactions were prepared at a final concentration of 10 μM FX (based on the $A_{280}$ absorbance and an extinction coefficient of 1.16) in a final volume of 50-100 μL in a reaction buffer containing 100 mM Tris, 50 mM NaCl, 5 mM $CaCl_2$, 0.1% PEG 8000, pH 8.1. Activation was initiated by the addition of RVV-ase to a final concentration of 5 μg/mL (5 μL of a 98 μg/mL dilution per 100 μL reaction or 2.5 μL per 50 μL reaction) at 37° C. for 45-60 min of activation time (previously determined to represent complete activation by collecting samples every 15 min and testing the increase in cleavage of Spectrafluor FXa fluorogenic substrate). Reactions were quenched with 1/10 volume of quench buffer containing 100 mM Tris, 50 mM NaCl, 5 mM, 100 mM EDTA, 0.1% PEG 8000, pH 8.1.

Assays were performed with a 1 mL reaction volume in a 0.4 cm×1 cm quartz cuvette under continuous stirring. Reactions contained 100-400 nM of the freshly activated FXa and 5 μM FMGB in an assay buffer containing 30 mM Hepes, 135 mM NaCl, 1 mM EDTA and 0.1% PEG 8000, pH 7.4. The fluorescein standard solution was freshly prepared at a stock concentration of 70 mM in DMF and the concentration confirmed by absorbance spectroscopy under standard conditions at 496 nm using an extinction coefficient of 89,125 $M^{-1}cm^{-1}$ in 0.1 N NaOH. FMGB was prepared at a stock concentration of 0.01 M in DMF based on the dry weight and the concentration confirmed by absorbance spectroscopy at 452 nm using an extinction coefficient of 19,498 in Phosphate Buffered Saline (PBS), pH 7.2. Assays were initiated by adding 5 μL of 1 mM FMGB (5 μM final concentration) to 1× assay buffer and first measuring the background hydrolysis of FMGB for 150-200 seconds before the addition of FXa to a final concentration of 100-400 nM based on the initial concentration determined by absorbance prior to activation by RVV-ase (see above). The release of fluorescein fluorescence in the burst phase of the reaction was followed for an additional 3600 seconds. A standard curve of free fluorescein was prepared by titration of the absorbance-calibrated fluorescein standard into 1× assay buffer in 20 nM steps to a final concentration of 260-300 nM.

For data analysis, reaction traces were imported into the Graphpad Prism software package and the contribution of background hydrolysis was subtracted from the curve by extrapolation of the initial measured rate of spontaneous FMGB hydrolysis, which was typically less than 5% of the total fluorescence burst. The corrected curve was fit to a single exponential equation with a linear component (to account for the slow rate of deacylation) of the form $\Delta Fluorescence=Amp(1-e^{-kt})+Bt$, where Amp=the amplitude of the burst phase under the saturating assay conditions outline above, k is the observed first order rate constant for acyl-enzyme formation and B is a bulk rate constant associated with complete turnover of FMGB. The concentration of active FXa protease was calculated by comparison of the fit parameter for amplitude to the fluorescein standard curve. The values from multiple assays were measured, averaged and the standard deviation determined. The amount of active FXa in the preparation therefore directly represents the concentration of FX in a stock preparation, which may be activated by FVIIa. This active site titrated value is employed when calculating the concentration of FX to be used in an indirect assay such as the TF-dependent and TF-independent assays described in Example 4.

Since modifications will be apparent to those of skill in this art, it is intended that this invention be limited only by the scope of the appended claims.

SEQUENCE LISTING (371 sequences)

SEQ ID NO: 1 - protein, 466 aa, Homo sapiens
  Factor VII precursor isoform a
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 2 - protein, 444 aa, Homo sapiens
  Factor VII precursor isoform b
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 3 - protein, 406 aa, Homo sapiens [sequence omitted]

SEQ ID NO: 4 - protein, 447 aa, Bos taurus
  Factor VII precursor
MLSQAWALALLCFLLSLWGSLPAVFLPQEQALSILHRPRRANGFLEELLPGSLERECREELCSFEEAHEIFRNEERTRQFWVSYNDGDQCASSPCQNGGSCEDQLRSYICFCPDGFEGRNCETDKQSQLICANDNGGCEQYCGADPGAGRFCWCHEGYALQADGVSCAPTVEYPCGKIPVLEKRNGSKPQGRIVGGHVCPKGECPWQAMLKLNGALLCGGTLVGPAWVVSAAHCFERLRSRGNLTAVLGEHDLSRVEGPEQERRVAQIIVPKQYVPGQTDHDVALLQLAQPVALGDHVAPLCLPDPDFADQTLAFVRFSAVSGWGQLLERGVTARKLMVVLVPRLLTQDCLQQSRQRPGGPVVTDNMFCAGYSDGSKDACKGDSGGPHATRFRGTWFLTGVVSWGEGCAAAGHFGIYTRVSRYTAWLRQLMGHPPSRQGFFQVPLLP

SEQ ID NO: 5 - protein, 446 aa, Mus musculus
  Factor VII precursor
MVPQAHGLLLLCFLLQLQGPLGTAVFITQEEAHGVLHRQRRANSLLEELWPGSLERECNEEQCSFEEAREIFKSPERTKQFWIVYSDGDQCASNPCQNGGTCQDHLKSYVCFCLLDFEGRNCEKSKNEQLICANENGDCDQYCRDHVGTKRTCSCHEDYTLQPDEVSCKPKVEYPCGRIPVVEKRNSSSRQGRIVGGNVCPKGECPWQAVLKINGLLLCGAVLLDARWIVTAAHCFDNIRYWGNITVVMGEHDFSEKDGDEQVRRVTQVIMPDKYIRGKINHDIALLRLHRPVTFTDYVVPLCLPEKSFSENTLARIRFSRVSGWGQLLDRGATALELMSIEVPRLMTQDCLEHAKHSSNTPKITENMFCAGYMDGTKDACKGDSGGPHATHYHGTWYLTGVVSWGEGCAAIGHIGVYTRVSQYIDWLVRHMDSKLQVGVFRLPLL

SEQ ID NO: 6 - protein, 466 aa, Pan paniscus
  Factor VII precursor
  UNSURE (0)...(0): Xaa could be any amino acid
MVSQALRLLCLLLGLQGCLAAGGVAEASGGETRDMPWKPGPHRVFITQEEAHGVLHRRRRANAFLEELRPGSLERECKEEQCSFEEAREIFKDLERTKLFWISYSDGDQCASSPCQNGGSCKDQLQSYICFCLPAFEGRNCETYKDDQLICVNENGGCEQYCSDHTGTKRSCRCHEGYSLLADGVSCTPTVEYPCGKIPILENRNASKPQGRIVGGKVCPKGECPWQXLLXVNGAQLCGGTLINTIWVASAAHCFDKIKNWRNLIAVLGEHDLSEHDGDEQSRRVAQVIIPSTYIPGTTNHDIALLRLHQPVVLTDHVVPLCLPERAFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCASVGHFGVYTRVSQYIEWLQKLMRSEPRPGVLLRAPFP

SEQ ID NO: 7 - protein, 466 aa, Pan troglodytes
  Factor VII precursor
  UNSURE (0)...(0): Xaa could be any amino acid
MVSQALRLLCLLLGLQGCLAAGGVAEASGGETRDXXWKPGPHRVFITQEEAHGVLHRRRRANAFLEELRPGSLERECKEEQCSFEEAREIFKDLERTKLFWISYSDGDQCASSPCQNGGSCKDQLQSYICFCLPAFEGRNCETYKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYIPGTTNHDIALLRLHQPVVLTDHVVPLCLPERAFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCASVGHFGVYTRVSQYIEWLQKLMRSEPRPGVLLRAPFP

SEQ ID NO: 8 - protein, 444 aa, Oryctolagus cuniculus
  Factor VII precursor
MAPQARGLGLCSLLALQASLAAVFITQEEAHSVLRRQRRANSFLEELRPGSLERECKEELCSFEEAREVFQSTERTKQFWITYNDGDQCASNPCQNGGSCEDQIQSYICFCLADFEGRNCEKNKNDQLICMYENGGCEQYCSDHVGSQRSCRCHEGYTLLPNGVSCTPTVDYPCGKVPALEKRGASNPQGRIVGGKVCPKGECPWQAALMNGSTLLCGGSLLDTHWVVSAAHCFDKLSSLRNLTIVLGEHDLSEHEGDEQVRHVAQLIMPDKYVPGKTDHDIALLRLLQPAALTNNVVPLCLPERNFSESTLATIRFSRVSGWGQLLYRGALARELMAIDVPRLMTQDCVEQSEHKPGSPEVTGNMFCAGYLDGSKDACKGDSGGPHATSYHGTWYLTGVVSWGEGCAAVGHVGVYTRVSRYTEWLSRLMRSKLHHGIQRHPFP

SEQ ID NO: 9 - protein, 446 aa, Rattus norvegicus
  Factor VII precursor
MVPQTHGLLLLYFLLQLQGPLGAVVFITQEEAHGVLHRQRRANSLLEELWSSSLERECNEERCSFEEAREIFKSPERTKQFWTIYSDGDQCASNPCQNGGTCQDHLKSYVCFCPLDFEGRNCEKNKNEQLICANENGDCDQYCRDHVGTKRTCSCHEDYVLQPDEVSCKPKVEYPCGRIPVVEKRNFSRPQGRIVGGYVCPKGECPWQAVLKFNEALLCGAVLLDTRWIVTAAHCFDKFGKLVNITVVLGEHDFSEKEGTEQVRLVEQVIMPNKYTRGRTDHDIALVRLHRPVTFTDYVVPLCLPERAFSENTLASIRFSRVSGWGQLLDRGATALELMVIEVPRLMTQDCLEHAKHSANTPRITENMFCAGYMDGTKDACKGDSGGPHATHYHGTWYLTGVVSWGEGCAAIGHIGVYTRVSQYIDWLVKYMDSKLRVGISRVSLL

SEQ ID NO: 10 - protein, 469 aa, Macaca mulatta
  Factor VII precursor
MVSRALGLLCLLLGLQGCLAAATFLPQAGSLRPQEEKTQDLLWKPGPHRVFVTQEEAHGVLHRQRRANSFLEELRPGSLERECKEEQCSFEEAREIFKDLERTKLFWISYSDGDQCASNPCQNGGSCKDQLQSYICFCLPSFEGRNYKDDQLICVNENGGCEQYCSDHAGAKRSCWCHEGYSLLADGVSCMPTVEYPCGKIPILEKRNASKPQGRIVGGRVCPKGECPWQVLLLVNGAQLCGGTLINTIWVVSAAHCFDKIKSWRNLTAVLGEHDLSEHEGDEQSRRVAQVIIPSTYVLGATNHDIALLRLQQPVVLTDHVVPLCLPERMFSERTLAFVRFSLVSGWGQLLDRGATALELMALNVPRLMTQDCLQQSQKAEASPNITEYMFCAGYSDGSRDSCKGDSGGPHATRYRGTWYLTGIVSWGQGCAAVGHFGVYTRVSQYIEWLQKLMHSEPRPGVLLRAPFP

SEQ ID NO: 11 - protein, 445 aa, Sus scrofa
  Factor VII precursor (isoform b)
MASLRPALLCLLLCLQGSLAAVFVGHEEAHSLLHRFRRANSFLEELWPGSLERECREEQCSFEEAREIFKSEERTRQFWVSYNDGDQCASNPCLNGGSCEDQLQAYICFCPEGFEGRNCETNKKSQLICMNDNGGCEQYCSDHAEAGRSCWCHEGYALQEDGVSCEPTVEYPCGKIPVLEKRNDSNPQGRIVGGKVCPKGECPWQAMLKLKGALLCGGTLLNTSWVVSAAHCFDRIRSWKDLTVVLGEHDLSKDEGDEQERPVAQVFVPDKYVPGKTDHDLALVRLARPVALTDHVVPLCLPERSFSERTLAFIRFSAVSGWGRLLDRGAKARVLMAIQVPRLMTQDCLEQARRRPGSPSITDNMFCAGYLDGSKDACKGDSGGPHATRFRGTWFLTGVVSWGEGCAATGRFGVYTRVSRYTAWLLGLMSAPPPPSEGLLRAPLP

SEQ ID NO: 12 - protein, 446 aa, Canis familiaris
  Factor VII precursor
MVAWAGELALLCFLLGLQGSLAAVFLTQEEAQGVLHRQRRANSFLEELRAGSLERECREEQCSFEEAREIFQDVDRTRQFWISYKDGDQCASNPCQNGGSCEDQLQSYICFCPDDFQGRNCETDKKDQLICMNENGGCQQYCSDHAEARRSCWCHEGYTLQDDGVSCMPIVEYPCGKIPVLEKRIGSNPQGRIVGGKVCPKGECPWQAAVKVDGKLLCGGTLIDAAWVVSAAHCFERIKNWKNLTVVLGEHDLSEDDGDEQERHVARVIVPDKYIPLKTNHDIALLHLRTPVAYTDHVVPLCLPEKTFSERTLAFIRFSTVSGWGQLLDRGATALQLMAIDVPRVMTQDCQEQSRRRSGSPAITENMFCAGYLDGSKDACQGDSGGPHATKFQGTWYLTGVVSWGEGCAAEGHFGVYTRVSQYIEWLRQLMVSSHTLRGLLRAPLP

SEQ ID NO: 13 - protein, 433 aa, Brachydanio rerio
  Factor VII precursor
MSLLLVFSVLWSLHYCHSAAVFVHRDEAHEVLIRSKRANSGWFEELKTGNLERECLEEKCSYEGAREVFEHTEATNEFWKIYDVKDHCASSPCEHDGLCTTQNADSYMCLCAPGFSGRHCEQSIGDVPDSCLHDNGGCEHFCTEQDGRRNCSCADGYYLDNGGQKCRSHEVFPCGKVPLLQAGKAADHQVDLRSRIVGGSECPKGHCPWQVLLKYGEKGFCGGVIYKPTWILTAAHCLEKLKVKFLRIVAGEHDLEVDEGTEQLIQVDQMFTHPAYVSETADSDIALLRLRTPIVYSVYAVPVCLPLREMAERELWAVSKHTVSGWGKRSEDGPTSRLLRRLLVPRIRTQECVQVSNLTLTSNMFCAGYIEGRQDSCKGDSGGPLVTRYRDTAFLLGIVSWGKGCARPGSYGIYTRVSNYLQWIRQTTNTTIH

SEQ ID NO: 14 - protein, 441 aa, Fugu rubripes
  Factor VII precursor
MRLRVFFTLVFTFTHCRAASVFLDADKAHDVLVRTRRYNSGWLEELQKGDLKRECLEEICSYEEAREVFEHTKTTDEFWKIYNRPNSCKSNPCLNGGSCSAEGSSYTCFCLPEFSGVDCELEYQTVPDTCLLENGGCEHFCHENSAGQRGNCSCADGYDLDVDGLSCKAKESVACGMVLSAQFEHNQLNPRARIVGGNECPKGECPWQVLLVYKGKGFCGGVIYKPTWILTASHCMADIDVQFLKVVAGEHNTEVDEGTEQIIQVSEIIMHEKYVPRTADNDIALLHLAVPITYTTYAIPVCLPTRPLAERELWAVSLHTVSGWGRRSENGPTSHLLRQLKVPRIRTQQCIEESGVVLTQNMFCAGYMEGRQDSCKGDSGGPLVTKYKKTVFLLGIVSWGKGCARPGNYGIYTRVANYLEWIHNRTATVNQPTNNTENFTT

SEQ ID NO: 15 - protein, 425 aa, Gallus gallus
  Factor VII precursor
MVSRQCVALLLCFPLLVPPSLEAVFLKQEEANSIFQRHRRANSFFEEIKLGPLERECIEEKCSFEEAREIYRDDERTKEFWHIYSDPNQCDSSPCQNGGSCDDQFQDYVCRCPPEYEGKSCETAVAENLKCIYDNGGCEQYCADEQSEKRVCFCAEGYALASDGVSCIPQVKYPCGTIPVLARKNTTAQGRIVGGVTCPPGECPWQALIIQDQKGKCGGSLLSPEWVVTAAHCLDYAHSKQLRVRLGEYSVKVAEKTEQESGVSKIIRHEEYTIGQVNHDIALLKLETPVNLTDFVVPICLPEKRFAVYELSSIKFSMVSGWGRLLDGGATSTFLMRVHLPRVKTQECEKQANLNITENMFCAGDLTGKKDSCKGDSGGPHATKYKNTWFLTGIVSWGKGCAVEGSYGVYTRVSRYINWLKRHME

SEQ ID NO: 16 - protein, 444 aa, Pongo pygmaeus
  Factor VII (fragment)
GVAEASGGETRDMQWKLGPHRVFITQEEAHGVLHRRRRANTFLEELRPGSLERECKEEQCSFEEAREIFKDLERTKLFWISYSDGDQCASSPCQNGGSCKDQLQSYICFCLPDFEGRNCEMYKDDQLICVNENGGCEQYCSDHMGAKRSCWCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSERDGDEQSRRVAQVIIPSTYVPGTTNHDIALLRLHQPVVLTDHVVPLCLPERTFSERTLAFVRFSLVSGWGQLLDRGATALELMALNVPRLMTQDCLQQSRKVGDSPNITEYMFCAGYSDGSKDSCKGDSGGPHATRYRGTWYLTGIVSWGQGCAAVGHFGVYTRVSQYIEWLQKLMCSEPRPGVLLRAPFP

SEQ ID NO: 17 - protein, 221 aa, Gorilla gorilla
  Factor VII (fragment)
  UNSURE (0)...(0): Xaa could be any amino acid
IWVVSAAHCFDKIKNWRNLIAVLGEHDLSEHDGDEQSRRVAQVIIPSMYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWXLTGIXSWGQGCATVGHFGVYTRVSQYIEWLQKLMRSEPRPGVLLRAPFP

SEQ ID NO: 18 - protein, 466 aa, Homo sapiens
  FVII variant L13P
MVSQALRLLCLLPGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 19 - protein, 466 aa, Homo sapiens
  FVII variant (precursor F64L)
MVSQALRLLCLLLGLQGCLAAGGVAKASGGETRDMPWKPGPHRVFVTQEEAHGVLHRRRRANALLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 20 - protein, 466 aa, Homo sapiens
  FVII variant (precursor L73Q)
MVSQALRLLCLLLGLQGCLAAGGVAKASGGETRDMPWKPGPHRVFVTQEEAHGVLHRRRRANAFLEELRPGSQERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 21 - protein, 466 aa, Homo sapiens
  FVII variant (precursor E79Q)
MVSQALRLLCLLLGLQGCLAAGGVAKASGGETRDMPWKPGPHRVFVTQEEAHGVLHRRRRANAFLEELRPGSLERECKQEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 22 - protein, 466 aa, Homo sapiens
  FVII variant (precursor S120P)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGPCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 23 - protein, 466 aa, Homo sapiens
  FVII variant (precursor C121F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSFKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 24 - protein, 466 aa, Hmo sapiens
  FVII variant (precursor L125P)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQPQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 25 - protein, 466 aa, Homo sapiens
  FVII variant (precursorY128C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSCICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 26 - protein, 466 aa, Homo sapiens
  FVII variant (precursor R139K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGKNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 27 - protein, 466 aa, Homo sapiens
  FVII variant (precursor R139Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGQNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 28 - protein, 466 aa, Homo sapiens
  FVII variant R139W
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGWNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 29 - protein, 466 aa, Homo sapiens
  FVII variant (precursor C151S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLISVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 30 - protein, 466 aa, Homo sapiens
  FVII variant (precursor E154K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNKNGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 31 - protein, 466 aa, Homo sapiens
  FVII variant (precursor G157C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGCCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 32 - protein, 466 aa, Homo sapiens
  FVII variant (precursorG157S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGSCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 33 - protein, 466 aa, Homo sapiens
  FVII variant (precursorG157V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGVCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 34 - protein, 466 aa, Homo sapiens
  FVII variant (precursor Q160R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCERYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 35 - protein, 466 aa, Homo sapiens
  FVII variant (precursor P194T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYTCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 36 - protein, 466 aa, Homo sapiens
  FVII variant (precursor C195R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPRGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 37 - protein, 466 aa, Homo sapiens
  FVII variant (precursor K197E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGEIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 38 - protein, 466 aa, Homo sapiens
  FVII variant (precursor R212Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGQIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 39 - protein, 466 aa, Homo sapiens
  FVII variant (precursor G216D)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGDKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 40 - protein, 466 aa, Homo sapiens
  FVII variant (precursor C238Y)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLYGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 41 - protein, 466 aa, Homo sapiens
  FVII variant (precursor T241N)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGNLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 42 - protein, 466 aa, Homo sapiens
  FVII variant (precursor C254Y)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHYFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 43 - protein, 466 aa, Homo sapiens
  FVII variant (precursor A266T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLITVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 44 - protein, 466 aa, Homo sapiens
  FVII variant (precursor R283W)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSWRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 45 - protein, 466 aa, Homo sapiens
  FVII variant (precursor V295D)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYDPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 46 - protein, 466 aa, Homo sapiens
  FVII variant (precursor D302H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHHIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 47 - protein, 466 aa, Homo sapiens
  FVII variant (precursor D302N)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHNIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 48 - protein, 466 aa, Homo sapiens
  FVII variant (precursor A304T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDITLLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 49 - protein, 466 aa, Homo sapiens
  FVII variant (precursor A304V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIVLLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 50 - protein, 466 aa, Homo sapiens
  FVII variant (precursor R307C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLCLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 51 - protein, 466 aa, Homo sapiens
  FVII variant (precursor R307H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLHLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 52 - protein, 466 aa, Homo sapiens
  FVII variant (precursor V312M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPMVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 53 - protein, 466 aa, Homo sapiens
  FVII variant (precursor E325K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPKRTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 54 - protein, 466 aa, Homo sapiens
  FVII variant (precursor T332M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERMLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 55 - protein, 466 aa, Homo sapiens
  FVII variant (precursor V341F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLFSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 56 - protein, 466 aa, Homo sapiens
  FVII variant (precursor A352T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGTTALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 57 - protein, 466 aa, Homo sapiens
  FVII variant (precursor A354V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATVLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 58 - protein, 466 aa, Homo sapiens
  FVII variant (precursor M358I)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELIVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 59 - protein, 466 aa, Homo sapiens
  FVII variant (precursor M358V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELVVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 60 - protein, 466 aa, Homo sapiens
  FVII variant (precursor P363R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVRRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 61 - protein, 466 aa, Homo sapiens
  FVII variant (precursor R364Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPQLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 62 - protein, 466 aa, Homo sapiens
  FVII variant (precursor T367S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMSQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 63 - protein, 466 aa, Homo sapiens
  FVII variant (precursor C370F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDFLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 64 - protein, 466 aa, Homo sapiens
  FVII variant (precursor C389G)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFGAGYSDGSKDSCKGDSGGPHATHYRGTWYLTGIVSWGQGCATVGHFGVYTRVSQYIEWLQKLMRSEPRPGVLLRAPFP

SEQ ID NO: 65 - protein, 466 aa, Homo sapiens
  FVII variant (precursor G391S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCASYSDGSKDSCKGDSGGPHATHYRGTWYLTGIVSWGQGCATVGHFGVYTRVSQYIEWLQKLMRSEPRPGVLLRAPFP

SEQ ID NO: 66 - protein, 466 aa, Homo sapiens
  FVII variant (precursor G402E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKEDSGGPHATHYRGTWYLTGIVSWGQGCATVGHFGVYTRVSQYIEWLQKLMRSEPRPGVLLRAPFP

SEQ ID NO: 67 - protein, 466 aa, Homo sapiens
  FVII variant (precursor G402R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKRDSGGPHATHYRGTWYLTGIVSWGQGCATVGHFGVYTRVSQYIEWLQKLMRSEPRPGVLLRAPFP

SEQ ID NO: 68 - protein, 466 aa, Homo sapiens
  FVII variant (precursor D403H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGHSGGPHATHYRGTWYLTGIVSWGQGCATVGHFGVYTRVSQYIEWLQKLMRSEPRPGVLLRAPFP

SEQ ID NO: 69 - protein, 466 aa, Homo sapiens [sequence omitted]

SEQ ID NO: 70 - protein, 466 aa, Homo sapiens
  FVII variant (precursor T419M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLMGIVSWGQGCATVGHFGVYTRVSQYIEWLQKLMRSEPRPGVLLRAPFP

SEQ ID NO: 71 - protein, 466 aa, Homo sapiens
  FVII variant (precursor G435E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFEVYTRVSQYIEWLQKLMRSEPRPGVLLRAPFP

SEQ ID NO: 72 - protein, 466 aa, Homo sapiens
  FVII variant (precursor E445K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIKWLQKLMRSEPRPGVLLRAPFP

SEQ ID NO: 73 - protein, 466 aa, Homo sapiens
  FVII variant (precursor R375W)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSWKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 74 - protein, 466 aa, Homo sapiens
  FVII variant (precursor R375K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSKKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 75 - protein, 304 aa, Homo sapiens
  TFPI isoform a precursor
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 76 - protein, 276 aa, Homo sapiens
  TFPI isoform a mature
DSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 77 - protein, 251 aa, Homo sapiens
  TFPI isoform b precursor
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 78 - protein, 222 aa, Homo sapiens
  TFPI isoform b mature
SEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 79 - protein, 213 aa, Homo sapiens
  TFPI-2 mature
DAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 80 - protein, 245 aa, Homo sapiens
  Chymotrypsinogen B mature
CGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 81 - DNA, 3141 bp, Homo sapiens
  FVII transcript variant 1
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacaaaaaaaaaaaaaaaaa

SEQ ID NO: 82 - DNA, 3075 bp, Homo sapiens
  FVII transcript variant 2
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacaaaaaaaaaaaaaaaaa

SEQ ID NO: 83 - protein, 46 aa, Homo sapiens
  factor IX Gla domain
YNSGKLEEFVQGNLERECMEEKCSFEEAREVFENTERTTEFWKQYV

SEQ ID NO: 84 - protein, 45 aa, Homo sapiens
  factor X Gla domain
ANSFLEEMKKGHLERECMEETCSYEEAREVFEDSDKTNEFWNKYK

SEQ ID NO: 85 - protein, 46 aa, Homo sapiens
  prothrombin/thrombin Gla domain
ANTFLEEVRKGNLERECVEETCSYEEAFEALESSTATDVFWAKYTA

SEQ ID NO: 86 - protein, 46 aa, Homo sapiens
  protein C Gla domain
ANSFLEELRHSSLERECIEEICDFEEAKEIFQNVDDTLAFWSKHVD

SEQ ID NO: 87 - protein, 46 aa, Homo sapiens
  protein S Gla domain
ANSLLEETKQGNLERECIEELCNKEEAREVFENDPETDYFYPKYLV

SEQ ID NO: 88 - protein, 47 aa, Homo sapiens
  osteocalcin (bone Gla protein) Gla domain
YLYQWLGAPVPYPDPLEPRREVCELNPDCDELADHIGFQEAYRRFYG

SEQ ID NO: 89 - protein, 47 aa, Homo sapiens
  matrix Gla protein Gla domain
RAKVQERIRERSKPVHELNREACDDYRLCERYAMVYGYNAAYNRYFR

SEQ ID NO: 90 - protein, 42 aa, Homo sapiens
  growth-arrest-specific protein 6 Gla domain
FEEAKQGHLERECVEELCSREEAREVFENDPETDYFYPRYLD

SEQ ID NO: 91 - protein, 46 aa, Homo sapiens
  protein Z Gla domain
AGSYLLEELFEGNLEKECYEEICVYEEAREVFENEVVTDEFWRRYK

SEQ ID NO: 92 - protein, 45 aa, Homo sapiens
  factor VII Gla domain
ANAFLEELRPGSLERECKEEQCSFEEAREIFKDAERTKLFWISYS

SEQ ID NO: 93 - protein, 40 aa, Notechis scutatus scutatus
  Venom coagulation factor Xa-like protease - Gla domain
  UNSURE (0)...(0): Xaa could be any amino acid
SNSLFEEIRPGNIERECIEEKCSKEEAREVFEDNEKTXXF

SEQ ID NO: 94 - protein, 46 aa, Tropidechis carinatus
  Venom coagulation factor Xa-like protease - Gla domain
SNSLFEEIRPGNIERECIEEKCSKEEAREVFEDNEKTETFWNVYVD

SEQ ID NO: 95 - protein, 464 aa, Homo sapiens
  Antithrombin III precursor
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 96 - protein, 432 aa, Homo sapiens [sequence omitted]

SEQ ID NO: 97 - protein, 263 aa, Homo sapiens
  THIOLEST (0)...(0): Mature tissue factor
SGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 98 - protein, 406 aa, Homo sapiens
  Factor VIIa variant V21D/E154V/M156Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 99 - DNA, 4278 bp, Artificial Sequence
  pCMV Script vector
atgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgattacgccaagctcgaaattaaccctcactaaagggaacaaaagctggagctccaccgcggtggcggccgctctagcccgggcggatcccccgggctgcaggaattcgatatcaagcttatcgataccgtcgacctcgagggggggcccggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagaatcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagaacatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagaacttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcc

SEQ ID NO: 100 - DNA, 45 bp, Artificial Sequence
  CBO-125 Factor VII Forward PCR Primer
gcatcatgacgtgacggatccgccaccatggtctcccaggccctc

SEQ ID NO: 101 - DNA, 45 bp, Artificial Sequence
  CBO-126 Factor VII Reverse PCR Primer
gatcgtacgatacgtgaattcctagggaaatggggctcgcaggag

SEQ ID NO: 102 - DNA, 1398 bp, Homo sapiens
  FVII cDNA (template for PCR)
atggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccc

SEQ ID NO: 103 - protein, 20 aa, Artificial Sequence
  serum albumin binding sequence
QRLMEDICLPRWGCLWEDDF

SEQ ID NO: 104 - protein, 14 aa, Artificial Sequence
  serum albumin binding sequence
IEDICLPRWGCLWE

SEQ ID NO: 105 - protein, 13 aa, Artificial Sequence
  serum albumin binding sequence
DICLPRWGCLWED

SEQ ID NO: 106 - protein, 13 aa, Artificial Sequence
  serum albumin binding sequence
IEDICLPRWGCLW

SEQ ID NO: 107 - protein, 17 aa, Artificial Sequence
  serum albumin binding sequence
GGGSIEDICLPRWGCLW

SEQ ID NO: 108 - protein, 13 aa, Artificial Sequence
  serum albumin binding sequence
DICLPRWGCLWED

SEQ ID NO: 109 - protein, 17 aa, Artificial Sequence
  serum albumin binding sequence
GGGSDICLPRWGCLWED

SEQ ID NO: 110 - protein, 10 aa, Artificial Sequence
  platelet integrin IIb-IIIa binding sequence
SFGRGDIRNV

SEQ ID NO: 111 - protein, 12 aa, Artificial Sequence
  platelet integrin IIb-IIIa binding sequence
CSFGRGDIRNVC

SEQ ID NO: 112 - protein, 16 aa, Artificial Sequence
  platelet integrin IIb-IIIa binding sequence
GGGSCSFGRGDIRNVC

SEQ ID NO: 113 - protein, 406 aa, Homo sapiens
  Q286N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGNLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 114 - protein, 406 aa, Homo sapiens
  Q286E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGELLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 115 - protein, 406 aa, Homo sapiens
  Q286D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGDLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 116 - protein, 406 aa, Homo sapiens
  Q286S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGSLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 117 - protein, 406 aa, Homo sapiens
  Q286T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGTLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 118 - protein, 406 aa, Homo sapiens
  Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 119 - protein, 406 aa, Homo sapiens
  Q286K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGKLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 120 - protein, 406 aa, Homo sapiens
  Q286A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGALLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 121 - protein, 406 aa, Homo sapiens
  Q286V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGVLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 122 - protein, 406 aa, Homo sapiens
  Q286M
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGMLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 123 - protein, 406 aa, Homo sapiens
  Q296L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGLLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 124 - protein, 406 aa, Homo sapiens
  Q286Y
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGYLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 125 - protein, 406 aa, Homo sapiens
  Q286G
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGGLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 126 - protein, 406 aa, Homo sapiens
  Q286F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGFLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 127 - protein, 406 aa, Homo sapiens
  Q286I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGILLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 128 - protein, 406 aa, Homo sapiens
  Q286P
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGPLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 129 - protein, 406 aa, Homo sapiens
  Q286H
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGHLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 130 - protein, 406 aa, Homo sapiens
  Q286W
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGWLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 131 - protein, 407 aa, Homo sapiens
  Q286R/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 132 - protein, 406 aa, Homo sapiens
  Q286R/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 133 - protein, 406 aa, Homo sapiens
  Q286R/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 134 - protein, 406 aa, Homo sapiens
  Q286R/S222A/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 135 - protein, 407 aa, Homo sapiens
  Q286R/S222A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 136 - protein, 407 aa, Homo sapiens
  Q286R/H257A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 137 - protein, 407 aa, Homo sapiens
  Q286R/S222A/H257A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 138 - protein, 406 aa, Homo sapiens
  Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 139 - protein, 406 aa, Homo sapiens
  Q286R/M298Q/K341Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCQGDSGGPHATHYRGTWYLTGIVSWGQGCATVGHFGVYTRVSQYIEWLQKLMRSEPRPGVLLRAPFP

SEQ ID NO: 140 - protein, 406 aa, Homo sapiens
  Q286R/M298Q/K199E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIENWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 141 - protein, 407 aa, Homo sapiens
  Q286R/M298Q/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 142 - protein, 406 aa, Homo sapiens
  Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 143 - protein, 406 aa, Homo sapiens
  Q286R/A292N/A294S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGNTSLELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 144 - protein, 406 aa, Homo sapiens
  A175S/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 145 - protein, 406 aa, Homo sapiens
  S222A/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 146 - protein, 406 aa, Homo sapiens
  H257S/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 147 - protein, 406 aa, Homo sapiens
  H257S/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 148 - protein, 406 aa, Homo sapiens
  S222A/H257A/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 149 - protein, 406 aa, Homo sapiens
  Q286R/H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 150 - protein, 406 aa, Homo sapiens
  S222A/H257A/Q286R/M158Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 151 - protein, 406 aa, Homo sapiens
  Q286R/K341D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCDGDSGGPHATHYRGTWYLTGIVSWGQGCATVGHFGVYTRVSQYIEWLQKLMRSEPRPGVLLRAPFP

SEQ ID NO: 152 - protein, 406 aa, Homo sapiens
  Q286R/Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 153 - protein, 406 aa, Homo sapiens
  Q286R/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 154 - protein, 406 aa, Homo sapiens
  Q286R/M298Q/Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 155 - protein, 406 aa, Homo sapiens
  Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 156 - protein, 406 aa, Homo sapiens
  Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 157 - protein, 406 aa, Homo sapiens
  Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 158 - protein, 406 aa, Homo sapiens
  M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 159 - protein, 406 aa, Homo sapiens
  T239S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTSNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 160 - protein, 406 aa, Homo sapiens
  T239N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTNNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 161 - protein, 406 aa, Homo sapiens
  T239Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTQNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 162 - protein, 406 aa, Homo sapiens
  T239V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 163 - protein, 406 aa, Homo sapiens
  T239L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTLNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 164 - protein, 406 aa, Homo sapiens
  T239H
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTHNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 165 - protein, 406 aa, Homo sapiens
  T239I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 166 - protein, 406 aa, Homo sapiens
  P321K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSKNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 167 - protein, 406 aa, Homo sapiens
  P321E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSENITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 168 - protein, 406 aa, Homo sapiens
  P321Y
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSYNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 169 - protein, 406 aa, Homo sapiens
  P321S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSSNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 170 - protein, 406 aa, Homo sapiens
  Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 171 - protein, 406 aa, Homo sapiens
  Q366E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGEGCATVGHFGVYTRVSQYIEWLQKLMRSEPRPGVLLRAPFP

SEQ ID NO: 172 - protein, 406 aa, Homo sapiens
  Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 173 - protein, 406 aa, Homo sapiens
  Q366T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGTGCATVGHFGVYTRVSQYIEWLQKLMRSEPRPGVLLRAPFP

SEQ ID NO: 174 - protein, 406 aa, Homo sapiens
  Q366S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGSGCATVGHFGVYTRVSQYIEWLQKLMRSEPRPGVLLRAPFP

SEQ ID NO: 175 - protein, 406 aa, Homo sapiens
  UNSURE (0)...(0): Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 176 - protein, 406 aa, Homo sapiens
  Q366I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGIGCATVGHFGVYTRVSQYIEWLQKLMRSEPRPGVLLRAPFP

SEQ ID NO: 177 - protein, 406 aa, Homo sapiens
  Q366L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGLGCATVGHFGVYTRVSQYIEWLQKLMRSEPRPGVLLRAPFP

SEQ ID NO: 178 - protein, 406 aa, Homo sapiens
  Q366M
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGMGCATVGHFGVYTRVSQYIEWLQKLMRSEPRPGVLLRAPFP

SEQ ID NO: 179 - protein, 406 aa, Homo sapiens
  H373D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGDFGVYTRVSQYIEWLQKLMRSEPRPGVLLRAPFP

SEQ ID NO: 180 - protein, 406 aa, Homo sapiens
  H373E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGEFGVYTRVSQYIEWLQKLMRSEPRPGVLLRAPFP

SEQ ID NO: 181 - protein, 406 aa, Homo sapiens
  H373S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGSFGVYTRVSQYIEWLQKLMRSEPRPGVLLRAPFP

SEQ ID NO: 182 - protein, 406 aa, Homo sapiens
  H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 183 - protein, 406 aa, Homo sapiens
  H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 184 - protein, 406 aa, Homo sapiens
  Q366D/H373E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGDGCATVGEFGVYTRVSQYIEWLQKLMRSEPRPGVLLRAPFP

SEQ ID NO: 185 - protein, 406 aa, Homo sapiens
  Q366V/H373V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGVFGVYTRVSQYIEWLQKLMRSEPRPGVLLRAPFP

SEQ ID NO: 186 - protein, 406 aa, Homo sapiens
  Q366V/H373L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGLFGVYTRVSQYIEWLQKLMRSEPRPGVLLRAPFP

SEQ ID NO: 187 - protein, 406 aa, Homo sapiens
  Q366V/H373I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGIFGVYTRVSQYIEWLQKLMRSEPRPGVLLRAPFP

SEQ ID NO: 188 - protein, 406 aa, Homo sapiens
  K161S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPSGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 189 - protein, 406 aa, Homo sapiens
  K161A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPAGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 190 - protein, 406 aa, Homo sapiens
  K161V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPVGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 191 - protein, 406 aa, Homo sapiens
  H216S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSESDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 192 - protein, 406 aa, Homo sapiens
  H216A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 193 - protein, 406 aa, Homo sapiens
  H216K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEKDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 194 - protein, 406 aa, Homo sapiens
  H216R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSERDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 195 - protein, 406 aa, Homo sapiens
  S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 196 - protein, 406 aa, Homo sapiens
  S222K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQKRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 197 - protein, 406 aa, Homo sapiens
  S222V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQVRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 198 - protein, 406 aa, Homo sapiens
  S222N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQNRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 199 - protein, 406 aa, Homo sapiens
  S222E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQERRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 200 - protein, 406 aa, Homo sapiens
  S222D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQDRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 201 - protein, 406 aa, Homo sapiens
  H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 202 - protein, 406 aa, Homo sapiens
  H257S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 203 - protein, 406 aa, Homo sapiens
  S222K/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQKRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 204 - protein, 406 aa, Homo sapiens
  H216A/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 205 - protein, 406 aa, Homo sapiens
  H216A/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 206 - protein, 406 aa, Homo sapiens
  S52A
ANAFLEELRPGSLERECKEEQCSFEEAREIFKDAERTKLFWISYSDGDQCAASPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 207 - protein, 406 aa, Homo sapiens
  S60A
ANAFLEELRPGSLERECKEEQCSFEEAREIFKDAERTKLFWISYSDGDQCASSPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 208 - protein, 406 aa, Homo sapiens
  E394N/P395A/R396S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNASPGVLLRAPFP

SEQ ID NO: 209 - protein, 406 aa, Homo sapiens
  R202S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWSNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 210 - protein, 406 aa, Homo sapiens
  A292N/A294S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 211 - protein, 406 aa, Homo sapiens
  G318N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVNDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 212 - protein, 406 aa, Homo sapiens
  A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 213 - protein, 406 aa, Homo sapiens
  K109N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 214 - protein, 406 aa, Homo sapiens
  A122N/G124S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 215 - protein, 406 aa, Homo sapiens
  A51N
ANAFLEELRPGSLERECKEEQCSFEEAREIFKDAERTKLFWISYSDGDQCNSSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 216 - protein, 406 aa, Homo sapiens
  T130N/E132S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPNVSYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 217 - protein, 406 aa, Homo sapiens
  A122N/G124S/E394N/P395A/R396S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNAAPGVLLRAPFP

SEQ ID NO: 218 - protein, 406 aa, Homo sapiens
  A122N/G124S/E394N/P395A/R396S/ G318N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVNDSPNITEYMFCAGYSDGSKDSCKGDSGGPHATHYRGTWYLTGIVSWGQGCATVGHFGVYTRVSQYIEWLQKLMRSNAAPGVLLRAPFP

SEQ ID NO: 219 - protein, 406 aa, Homo sapiens
  S52A/S60A
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 220 - protein, 406 aa, Homo sapiens
  S52N/P54S
ANAFLEELRPGSLERECKEEQCSFEEAREIFKDAERTKLFWISYSDGDQCANSSCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 221 - protein, 406 aa, Homo sapiens
  S119N/L121S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYNLSADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 222 - protein, 406 aa, Homo sapiens
  T128N/P129A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 223 - protein, 406 aa, Homo sapiens
  Q66N/Y68S
ANAFLEELRPGSLERECKEEQCSFEEAREIFKDAERTKLFWISYSDGDQCASSPCQNGGSCKDQLNSSICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 224 - protein, 406 aa, Homo sapiens
  S52N/P54S/A122N/G124S/E394N/P395A/R396S
ANAFLEELRPGSLERECKEEQCSFEEAREIFKDAERTKLFWISYSDGDQCANSSCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNASPGVLLRAPFP

SEQ ID NO: 225 - protein, 406 aa, Homo sapiens
  K109N/A292N/A294S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 226 - protein, 406 aa, Homo sapiens
  K109N/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 227 - protein, 417 aa, Homo sapiens
  S103S111delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCQRLMEDICLPRWGCLWEDDFCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 228 - protein, 414 aa, Homo sapiens
  H115S126delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCQRLMEDICLPRWGCLWEDDFCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 229 - protein, 419 aa, Homo sapiens
  T128P134delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCQRLMEDICLPRWGCLWEDDFCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 230 - protein, 411 aa, Homo sapiens
  S103S111delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCIEDICLPRWGCLWECRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 231 - protein, 408 aa, Homo sapiens
  H115S126delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCIEDICLPRWGCLWECTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 232 - protein, 413 aa, Homo sapiens
  128P134delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCIEDICLPRWGCLWECGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 233 - protein, 410 aa, Homo sapiens
  S103S111delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCDICLPRWGCLWEDCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 234 - protein, 407 aa, Homo sapiens
  H115S126delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCDICLPRWGCLWEDCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 235 - protein, 412 aa, Homo sapiens
  T128P134delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCDICLPRWGCLWEDCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 236 - protein, 419 aa, Homo sapiens
  P406insIEDICLPRWGCLW
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPIEDICLPRWGCLW

SEQ ID NO: 237 - protein, 423 aa, Homo sapiens
  P406insGGGSIEDICLPRWGCLW
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSIEDICLPRWGCLW

SEQ ID NO: 238 - protein, 419 aa, Homo sapiens
  P406insDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPDICLPRWGCLWED

SEQ ID NO: 239 - protein, 423 aa, Homo sapiens
  P406insGGGSDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSDICLPRWGCLWED

SEQ ID NO: 240 - protein, 407 aa, Homo sapiens
  S103S111delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSFGRGDIRNVCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 241 - protein, 404 aa, Homo sapiens
  H115S126delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCSFGRGDIRNVCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 242 - protein, 409 aa, Homo sapiens
  T128P134delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCSFGRGDIRNVCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 243 - protein, 418 aa, Homo sapiens
  P406insCSFGRGDIRNVC
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPCSFGRGDIRNVC

SEQ ID NO: 244 - protein, 422 aa, Homo sapiens
  P406insGGGSCSFGRGDIRNVC
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSCSFGRGDIRNVC

SEQ ID NO: 245 - protein, 407 aa, Homo sapiens
  S222A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 246 - protein, 407 aa, Homo sapiens
  H257A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 247 - protein, 407 aa, Homo sapiens
  S222A/H257A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 248 - protein, 406 aa, Homo sapiens
  S222A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 249 - protein, 406 aa, Homo sapiens
  H257A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 250 - protein, 406 aa, Homo sapiens
  S222A/H257A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 251 - protein, 406 aa, Homo sapiens
  S222A/A292N/A294S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 252 - protein, 406 aa, Homo sapiens
  A175S/S222A/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 253 - protein, 406 aa, Homo sapiens
  S222A/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 254 - protein, 406 aa, Homo sapiens
  H257S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 255 - protein, 406 aa, Homo sapiens
  S222A/H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 256 - protein, 406 aa, Homo sapiens
  V158T/L287T/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKTCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQTLDRGATALELKVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 257 - protein, 406 aa, Homo sapiens
  V21D/L287T/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQTLDRGATALELKVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 258 - protein, 411 aa, Homo sapiens
  S103S111delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCIEDICLPRWGCLWECRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 259 - protein, 410 aa, Homo sapiens
  S103S111delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCDICLPRWGCLWEDCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 260 - protein, 414 aa, Homo sapiens
  H115S126delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCQRLMEDICLPRWGCLWEDDFCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 261 - protein, 408 aa, Homo sapiens
  H115S126delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCIEDICLPRWGCLWECTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 262 - protein, 407 aa, Homo sapiens
  H115S126delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCDICLPRWGCLWEDCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 263 - protein, 419 aa, Homo sapiens
  T128P134delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCQRLMEDICLPRWGCLWEDDFCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 264 - protein, 413 aa, Homo sapiens
  T128P134delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCIEDICLPRWGCLWECGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 265 - protein, 417 aa, Homo sapiens
  S103S111delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCQRLMEDICLPRWGCLWEDDFCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 266 - protein, 412 aa, Homo sapiens
  T128P134delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCDICLPRWGCLWEDCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 267 - protein, 407 aa, Homo sapiens
  S103S111delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSFGRGDIRNVCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 268 - protein, 404 aa, Homo sapiens
  H115S126delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCSFGRGDIRNVCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 269 - protein, 409 aa, Homo sapiens
  T128P134delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCSFGRGDIRNVCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 270 - protein, 406 aa, Homo sapiens
  M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 271 - protein, 406 aa, Homo sapiens
  S119N/L121S/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYNLSADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 272 - protein, 406 aa, Homo sapiens
  T128N/P129A/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 273 - protein, 406 aa, Homo sapiens
  A122N/G124S/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 274 - protein, 407 aa, Homo sapiens
  GlaSwapFIX/E39L/Q286R/M298Q
YNSGKLEEFVQGNLERECMEEKCSFEEAREVFENTERTTLFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 275 - protein, 407 aa, Homo sapiens
  GlaSwapFIX/K42I/Q286R/M298Q/
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 276 - protein, 407 aa, Homo sapiens
  GlaSwapFIX/Q43S/Q286R/M298Q/
YNSGKLEEFVQGNLERECMEEKCSFEEAREVFENTERTTEFWKSYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 277 - protein, 407 aa, Homo sapiens
  GlaSwapFIX/M18K/Q286R/M298Q/
YNSGKLEEFVQGNLERECKEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 278 - protein, 407 aa, Homo sapiens
  GlaSwapFIX/M18K/E39L/K42I/Q43S/Q286R/M298Q/
YNSGKLEEFVQGNLERECKEEKCSFEEAREVFENTERTTLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 279 - protein, 406 aa, Homo sapiens
  T128N/P129A/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 280 - protein, 406 aa, Homo sapiens
  T128N/P129A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 281 - protein, 406 aa, Homo sapiens
  T128N/P129A/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 282 - protein, 406 aa, Homo sapiens
  V158D/Q286R/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 283 - protein, 406 aa, Homo sapiens
  T128N/P129A/V158D/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 284 - protein, 406 aa, Homo sapiens
  T128N/P129A/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 285 - protein, 407 aa, Homo sapiens
  GlaSwapFIX/T128N/P129A/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 286 - protein, 407 aa, Homo sapiens
  GlaSwapFIX/T128N/P129A/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 287 - protein, 406 aa, Homo sapiens
  T128N/P129A/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 288 - protein, 406 aa, Homo sapiens
  T128N/P129A/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 289 - protein, 406 aa, Homo sapiens
  S52A/S60A/V158D/E296V/M298Q
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 290 - protein, 406 aa, Homo sapiens
  S52A/S60A/Q286R
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 291 - protein, 406 aa, Homo sapiens
  S52A/S60A/S222A
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 292 - protein, 407 aa, Homo sapiens
  GlaSwapFIX/S52A/S60A/S222A/Q286R
YNSGKLEEFVQGNLERECMEEKCSFEEAREVFENTERTTEFWKQYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 293 - protein, 406 aa, Homo sapiens
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 294 - protein, 407 aa, Homo sapiens
  GlaSwapFIX/S52A/S60A/Q286R/M298Q
YNSGKLEEFVQGNLERECMEEKCSFEEAREVFENTERTTEFWKQYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 295 - protein, 406 aa, Homo sapiens
  S52A/S60A/S222A/H257A/Q286R/M298Q
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 296 - protein, 406 aa, Homo sapiens
  S52A/S60A/Q286R/H373F
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 297 - protein, 406 aa, Homo sapiens
  S52A/S60A/ Q286R/M298Q/H373F
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 298 - protein, 406 aa, Homo sapiens
  V158D/T239V/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 299 - protein, 406 aa, Homo sapiens
  T239V/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTVVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 300 - protein, 406 aa, Homo sapiens
  S222A/T239V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 301 - protein, 407 aa, Homo sapiens
  GlaSwapFIX/S222A/T239V/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 302 - protein, 406 aa, Homo sapiens
  T239V/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 303 - protein, 406 aa, Homo sapiens
  S222A/T239V/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 304 - protein, 407 aa, Homo sapiens
  GlaSwapFIX/T239V/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 305 - protein, 406 aa, Homo sapiens
  T239V/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 306 - protein, 406 aa, Homo sapiens
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 307 - protein, 406 aa, Homo sapiens
  V158D/T239I/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 308 - protein, 406 aa, Homo sapiens
  T239I/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 309 - protein, 406 aa, Homo sapiens
  S222A/T239I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 310 - protein, 407 aa, Homo sapiens
  GlaSwapFIX/S222A/T239I/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 311 - protein, 406 aa, Homo sapiens
  T239I/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 312 - protein, 406 aa, Homo sapiens
  S222A/T239I/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 313 - protein, 407 aa, Homo sapiens
  GlaSwapFIX/T239I/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 314 - protein, 406 aa, Homo sapiens
  T239I/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 315 - protein, 406 aa, Homo sapiens
  T239I/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 316 - protein, 407 aa, Homo sapiens
  GlaSwapFIX/S222A/Q286R/H373F
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 317 - protein, 407 aa, Homo sapiens
  GlaSwapFIX/S222A/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 318 - protein, 407 aa, Homo sapiens
  GlaSwapFIX/S222A/Q286R/M298Q/H373F
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 319 - protein, 406 aa, Homo sapiens
  V158D/E296V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 320 - protein, 406 aa, Homo sapiens
  V158D/Q286R/E296V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 321 - protein, 406 aa, Homo sapiens
  H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 322 - protein, 406 aa, Homo sapiens
  H257S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 323 - protein, 407 aa, Homo sapiens
  GlaSwapFIX/S222A/H257S/Q286R/
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 324 - protein, 406 aa, Homo sapiens
  S222A/H257S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 325 - protein, 406 aa, Homo sapiens
  H257S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 326 - protein, 406 aa, Homo sapiens
  S222A/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 327 - protein, 407 aa, Homo sapiens
  GlaSwapFIX/Q366V
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 328 - protein, 406 aa, Homo sapiens
  S222A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 329 - protein, 406 aa, Homo sapiens
  T28N/P129A/A175S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 330 - protein, 406 aa, Homo sapiens
  A122N/G124S/A175S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 331 - protein, 406 aa, Homo sapiens
  T128N/P129A/A175S/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 332 - protein, 406 aa, Homo sapiens
  A122N/G124S/A175S/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 333 - protein, 406 aa, Homo sapiens
  T128N/P129A/A175S/Q286
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 334 - protein, 406 aa, Homo sapiens
  A122N/G124S/A175S/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 335 - protein, 407 aa, Homo sapiens
  GlaSwapFIX/T128N/P129A/A175S/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 336 - protein, 407 aa, Homo sapiens
  GlaSwapFIX/A122N/G124S/A175S/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 337 - protein, 406 aa, Homo sapiens; identical to SEQ ID NO: 272
  T128N/P129A/A175S/Q286R/M298Q

SEQ ID NO: 338 - protein, 406 aa, Homo sapiens
  A122N/G124S/A175S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 339 - protein, 406 aa, Homo sapiens
  T128N/P129A/A175S/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 340 - protein, 406 aa, Homo sapiens
  A122N/G124S/A175S/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 341 - protein, 406 aa, Homo sapiens
  T128N/P129A/A175S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 342 - protein, 406 aa, Homo sapiens
  A122N/G124S/A175S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 343 - protein, 406 aa, Homo sapiens
  E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 344 - protein, 406 aa, Homo sapiens
  V158E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKECPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 345 - protein, 406 aa, Homo sapiens
  E296R/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALRLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 346 - protein, 406 aa, Homo sapiens
  K337A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSADSCKGDSGGPHATHYRGTWYLTGIVSWGQGCATVGHFGVYTRVSQYIEWLQKLMRSEPRPGVLLRAPFP

SEQ ID NO: 347 - protein, 406 aa, Homo sapiens
  V158D/E296V/M298Q/K337A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSADSCKGDSGGPHATHYRGTWYLTGIVSWGQGCATVGHFGVYTRVSQYIEWLQKLMRSEPRPGVLLRAPFP

SEQ ID NO: 348 - protein, 406 aa, Homo sapiens
  V253N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVNLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 349 - protein, 406 aa, Homo sapiens
  T106N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHNGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 350 - protein, 406 aa, Homo sapiens
  T106N/V253N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHNGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVNLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 351 - protein, 406 aa, Homo sapiens
  K143N/N145T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILENRTASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 352 - protein, 406 aa, Homo sapiens
  R315N/V317T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSNKTGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 353 - protein, 406 aa, Homo sapiens; identical to SEQ ID NO: 351
  K143N/N145T/R315N/V317T

SEQ ID NO: 354 - protein, 406 aa, Homo sapiens
  T128N/P129A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 355 - protein, 407 aa, Homo sapiens
  {Gla Swap FIX /K43I}/T128N/P129A/Q286R/M298Q
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 356 - protein, 406 aa, Homo sapiens
  T128N/P129A/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 357 - protein, 407 aa, Homo sapiens
  {Gla Swap FIX /K43I}/Q286R/M298Q/Q366N
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 358 - protein, 407 aa, Homo sapiens
  {Gla Swap FIX /K43I}/ T128N/P129A/Q286R/M298Q/Q366N
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 359 - protein, 406 aa, Homo sapiens
  T128N/P129A/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 360 - protein, 406 aa, Homo sapiens; identical to SEQ ID NO: 282
  V158D/Q286R/E296V/M298Q

SEQ ID NO: 361 - protein, 406 aa, Homo sapiens
  M298Q/Q366N/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGNGCATVGFFGVYTRVSQYIEWLQKLMRSEPRPGVLLRAPFP

SEQ ID NO: 362 - protein, 406 aa, Homo sapiens
  T239V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 363 - protein, 406 aa, Homo sapiens
  T239I/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 364 - protein, 406 aa, Homo sapiens
  T128N/P129A/Q286R/M298Q/Q366N/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGFFGVYTRVSQYIEWLQKLMRSEPRPGVLLRAPFP

SEQ ID NO: 365 - protein, 406 aa, Homo sapiens
  T239V/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 366 - protein, 406 aa, Homo sapiens
  T239I/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 367 - protein, 406 aa, Homo sapiens
  T128N/P129A/T239V/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 368 - protein, 406 aa, Homo sapiens
  T128N/P129A/S222A/T239V/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 369 - protein, 406 aa, Homo sapiens
  T128N/P129A/T239V/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 370 - protein, 406 aa, Homo sapiens
  T128N/P129A/T239I/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 371 - protein, 406 aa, Homo sapiens
  T128N/P129A/T239I/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

The invention claimed is:

1. A modified factor VII (FVII) polypeptide, comprising amino acid replacements at positions corresponding to positions 128, 129, 286 and 298 in a FVII polypeptide having the sequence of amino acids set forth in SEQ ID NO:3, wherein:
the amino acid replacement at the position corresponding to 128 is Asn (N), position 129 is Ala (A), position 286 is Arg (R), and position 298 is Gln (Q);
the amino acid sequence of the modified FVII polypeptide has at least 90% sequence identity to a polypeptide of any of SEQ ID NOS.:1-3;
the corresponding positions in the modified FVII polypeptide are identified by alignment of the amino acid sequence of the modified FVII polypeptide with the amino acid sequence set forth in SEQ ID NO: 3; and
the modified FVII polypeptide, when in its activated form, exhibits procoagulant activity.

2. The modified FVII polypeptide of claim 1, wherein:
the amino acid sequence of the modified FVII polypeptide has at least 95% sequence identity to a polypeptide of any of SEQ ID NOS:1-3.

3. The modified FVII polypeptide of claim 1, wherein the modified FVII polypeptide is a FVIIa polypeptide and has at least 90% sequence identity with the sequence of amino acids set forth in SEQ ID NO: 3.

4. A modified factor VII (FVII) polypeptide that consists of the sequence of amino acids set forth in SEQ ID NO:280.

5. The modified FVII polypeptide of claim 1, wherein the amino acid sequence of the modified FVII polypeptide has at least 95% sequence identity to the polypeptide of SEQ ID NO: 3.

6. The modified FVII polypeptide of claim 1, wherein the modified polypeptide is the mature form.

7. The modified FVII polypeptide of claim 1, wherein the modified polypeptide is a single chain zymogen, a zymogen-like two-chain polypeptide or a fully activated two-chain form.

8. The modified FVII polypeptide of claim 2 that is activated.

9. The modified FVII polypeptide of claim 2 that is a mature polypeptide.

10. The modified FVII polypeptide of claim 1 that is a single-chain polypeptide.

11. The modified FVII polypeptide of claim 1 that is a two-chain polypeptide.

12. The modified FVII polypeptide of claim 1 that is fully activated.

13. A pharmaceutical composition, comprising a therapeutically effective concentration or amount of a modified FVII polypeptide of claim 1, in a pharmaceutically acceptable vehicle.

14. The pharmaceutical composition of claim 13 that is formulated for local, systemic or topical administration.

15. The pharmaceutical composition of claim 13 that is formulated for oral, nasal, pulmonary buccal, transdermal, subcutaneous, intraduodenal, enteral, parenteral, intravenous or intramuscular administration.

16. The pharmaceutical composition of claim 13 that is formulated for controlled-release.

17. The pharmaceutical composition of claim 13 that is formulated for single-dosage administration.

18. A method of treating a disease or condition in a subject in need thereof, said method comprising administering an effective amount of the pharmaceutical composition of claim 13 to the subject, wherein the subject has a disease or condition that is selected from the group consisting of blood coagulation disorders, hematologic disorders, hemorrhagic disorders, hemophilias, factor VII deficiency and bleeding disorders, and bleeding complications due to surgery or trauma.

19. The method of claim 18, wherein the disease or condition is treated by administration of active FVII (FVIIa).

20. The method of claim 18, wherein treatment with the pharmaceutical composition ameliorates or alleviates the symptoms associated with the disease or condition.

21. The method of claim 18, further comprising monitoring the subject for changes in the symptoms associated with disease or condition that is treated by administration of FVII or a procoagulant.

22. The method of claim 18, wherein:
the disease or condition to be treated is hemophilia;
and the hemophilia is selected from among hemophilia A, hemophilia B and hemophilia C.

23. The method of claim 22, wherein the hemophilia is congenital.

24. The method of claim 22, wherein the hemophilia is acquired.

25. The method of claim 18, wherein the disease or condition is due to a bleeding complication due to surgery or trauma.

26. The method of claim 25, wherein the bleeding is manifested as acute haemarthroses, chronic haemophilic arthropathy, haematomas, haematuria, central nervous system bleedings, gastrointestinal bleedings, or cerebral haemorrhage.

27. The method of claim 25, wherein the bleeding is due to dental extraction.

28. The method of claim 25, wherein the surgery is heart surgery, angioplasty, lung surgery, abdominal surgery, spinal surgery, brain surgery, vascular surgery, dental surgery, or organ transplant surgery.

29. The method of claim 28, wherein the transplant surgery is selected from among transplantation of bone marrow, heart, lung, pancreas, and liver.

30. The method of claim 18, wherein the subject has autoantibodies to factor VIII or factor IX.

31. The method of claim 18, further comprising administering one or more additional coagulation factors.

32. The method of claim 31, wherein the one or more additional coagulation factors are selected from among plasma purified or recombinant coagulation factors, vitamin K-dependent procoagulants, protein C inhibitors, plasma, platelets, red blood cells and corticosteroids.

33. A pharmaceutical composition, comprising the modified FVII polypeptide of claim 4 in a pharmaceutically acceptable vehicle.

34. A modified two-chain activated Factor VII (FVIIa) polypeptide, consisting of the amino acid sequence of SEQ ID NO:280 cleaved between the arginine at position 152 and the isoleucine at position 153.

35. A pharmaceutical composition, comprising the modified FVIIa polypeptide of claim 34 and a pharmaceutically acceptable carrier.

36. The pharmaceutical composition of claim 35 that is formulated for intravenous, parenteral, intramuscular or subcutaneous administration.

37. The pharmaceutical composition of claim 36 that is lyophilized.

38. A kit, comprising the composition of claim 37, and a pharmaceutically acceptable diluent.

39. A method of treating hemophilia, comprising administering to a subject in need of treatment for hemophilia a therapeutically effective amount of the composition of claim 35.

40. The method of claim 39, wherein said subject has Hemophilia A.

41. The method of claim 39, wherein said subject has Hemophilia B.

42. The method of claim 39, wherein said subject has hemophilia with inhibitors.

43. The pharmaceutical composition of claim 13, wherein the modified FVII polypeptide is activated.

44. A modified two-chain activated Factor VII (FVIIa) polypeptide with at least 90% amino acid sequence identity to SEQ ID NO:280, wherein the amino acids corresponding to positions 128, 129, 286 and 298 of SEQ ID NO:280 are invariant.

45. The modified FVIIa polypeptide of claim 44 with at least 95% amino acid sequence identity to SEQ ID NO:280.

46. The modified FVIIa polypeptide of claim 34, wherein the first and second chains of said two-chain polypeptide consist respectively of amino acids 1-152 and 153-406 of SEQ ID NO:280.

47. The modified FVIIa polypeptide of claim 46, wherein the first and second chains are linked by at least one disulphide bridge.

48. The modified FVIIa polypeptide of claim 34, wherein the FVIIa polypeptide is zymogen-like.

49. The modified FVIIa polypeptide of claim 34, wherein the FVIIa polypeptide is fully activated.

50. The modified FVIIa polypeptide of claim 34, wherein the FVIIa polypeptide is post-translationally modified.

51. The modified FVIIa polypeptide of claim 50, wherein the post-translational modification comprises glycosylation.

52. The modified FVIIa polypeptide of claim 51, wherein a post-translational modification is O-linked glycosylation.

53. The modified FVIIa polypeptide of claim 51, wherein a post-translational modification is N-linked glycosylation.

54. The modified FVIIa polypeptide of claim 50, wherein a post-translational modification is carboxylation of glutamic acid to γ-carboxyglutamic acid.

55. The modified FVIIa polypeptide of claim 50, wherein a post-translational modification is hydroxylation of aspartic acid to β-hydroxyaspartic acid.

56. The modified FVIIa polypeptide of claim 34, wherein the FVIIa polypeptide exhibits increased catalytic activity compared to wild type FVIIa polypeptide.

57. A pharmaceutical composition, comprising the modified FVII polypeptide of claim 4 and a pharmaceutically acceptable carrier.

58. The pharmaceutical composition of claim 57 that is formulated for intravenous, parenteral, intramuscular or subcutaneous administration.

59. The pharmaceutical composition of claim 58 that is lyophilized.

60. A kit, comprising the composition of claim 59, and a pharmaceutically acceptable diluent.

61. The modified FVII polypeptide of claim 4, wherein the modified FVII polypeptide is a single chain zymogen.

62. The modified FVII polypeptide of claim 4, wherein the modified FVII polypeptide is a zymogen-like two-chain polypeptide.

63. The modified FVII polypeptide of claim 4, wherein the modified FVII polypeptide is a fully activated two-chain form.

64. The modified FVII polypeptide of claim 4, wherein the modified FVII polypeptide is post-translationally modified.

65. The modified FVII polypeptide of claim 64, wherein the post-translational modification comprises glycosylation.

66. The modified FVII polypeptide of claim 65, wherein a post-translational modification is O-linked glycosylation.

67. The modified FVII polypeptide of claim 65, wherein a post-translational modification is N-linked glycosylation.

68. The modified FVII polypeptide of claim 64, wherein a post-translational modification is carboxylation of glutamic acid to γ-carboxyglutamic acid.

69. The modified FVII polypeptide of claim 64, wherein a post-translational modification is hydroxylation of aspartic acid to β-hydroxyaspartic acid.

70. The modified FVII polypeptide of claim 1, wherein the modified FVII polypeptide exhibits increased catalytic activity compared to wild type FVII polypeptide.

71. The modified FVII polypeptide of claim 1, wherein the sequence of the FVII polypeptide without the modifications consists of the sequence of amino acids set forth in any one of SEQ ID NOS: 1-3.

* * * * *